(12) United States Patent
Berry et al.

(10) Patent No.: US 8,809,259 B2
(45) Date of Patent: Aug. 19, 2014

(54) CHARGED NUTRITIVE PROTEINS AND METHODS

(71) Applicant: Pronutria, Inc., Cambridge, MA (US)

(72) Inventors: David Arthur Berry, Brookline, MA (US); Brett Adam Boghigian, South Boston, MA (US); Nathaniel W. Silver, Cambridge, MA (US); Geoffrey von Maltzahn, Boston, MA (US); Mike Hamill, Cambridge, MA (US); Rajeev Chillakuru, Cambridge, MA (US)

(73) Assignee: Pronutria, Inc., Cambridge, MA (US)

( * ) Notice: Subject to any disclaimer, the term of this patent is extended or adjusted under 35 U.S.C. 154(b) by 0 days.

(21) Appl. No.: 13/836,855

(22) Filed: Mar. 15, 2013

(65) Prior Publication Data

US 2013/0296231 A1 Nov. 7, 2013

Related U.S. Application Data

(60) Provisional application No. 61/615,816, filed on Mar. 26, 2012.

(51) Int. Cl.

| A23J 3/04 | (2006.01) |
| C07K 14/435 | (2006.01) |
| A23L 1/305 | (2006.01) |
| C07K 14/415 | (2006.01) |
| A23J 3/00 | (2006.01) |
| C12N 15/82 | (2006.01) |

(52) U.S. Cl.
CPC .............. *A23L 1/3058* (2013.01); *A23L 1/3053* (2013.01); *C07K 14/415* (2013.01); *A23V 2002/00* (2013.01); *A23J 3/04* (2013.01); *C12N 15/8251* (2013.01)
USPC ................. 514/1.1; 514/4.9; 426/2; 426/656; 530/350

(58) Field of Classification Search
None
See application file for complete search history.

(56) References Cited

U.S. PATENT DOCUMENTS

| 4,687,782 | A | 8/1987 | Brantman |
| 6,291,245 | B1 | 9/2001 | Kopetzki et al. |
| 6,361,966 | B1 | 3/2002 | Walker et al. |
| 6,495,344 | B1 | 12/2002 | Carr |
| 7,252,972 | B2 | 8/2007 | Kikuchi et al. |
| 7,790,688 | B2 | 9/2010 | Wolfe et al. |
| 8,071,122 | B2 | 12/2011 | Yamka et al. |
| 8,329,646 | B2 | 12/2012 | Tisdale et al. |
| 8,486,888 | B2 | 7/2013 | Greenberg |
| 2004/0123343 | A1* | 6/2004 | La Rosa et al. .............. 800/278 |
| 2005/0010973 | A1 | 1/2005 | Rao et al. |
| 2006/0159724 | A1 | 7/2006 | Bell |
| 2007/0264688 | A1 | 11/2007 | Venter |
| 2008/0032000 | A1 | 2/2008 | Schnorr et al. |
| 2008/0268038 | A1 | 10/2008 | Wolfe |
| 2009/0181903 | A1 | 7/2009 | Wolfe et al. |
| 2009/0197820 | A1 | 8/2009 | Wolfe et al. |
| 2009/0203606 | A1 | 8/2009 | Wolfe et al. |
| 2009/0252684 | A1 | 10/2009 | Wolfe et al. |
| 2010/0179089 | A1 | 7/2010 | Deutz et al. |
| 2010/0189864 | A1* | 7/2010 | Marsland ...................... 426/556 |
| 2010/0267831 | A1 | 10/2010 | Kobayashi et al. |
| 2010/0286023 | A1 | 11/2010 | Wolfe et al. |
| 2012/0178672 | A1 | 7/2012 | Wolfe et al. |
| 2013/0090297 | A1 | 4/2013 | Troup et al. |

FOREIGN PATENT DOCUMENTS

| WO | WO 02-087562 A1 | 11/2002 |
| WO | WO 2010-126353 A1 | 11/2010 |
| WO | WO 2010-144821 A1 | 12/2010 |
| WO | WO 2011-078677 A2 | 6/2011 |
| WO | WO 2011-119033 A1 | 9/2011 |

OTHER PUBLICATIONS

Aalberse R. C., "Structural biology of allergens", J. Allergy Clin. Immunol. 106, 228-238 (2000).

Abou-Samra R. et al., "Effect of different protein sources on satiation and short-term satiety when consumed as a starter", Nutr J. 10:139 (Dec. 23, 2011).

Acheson K. et al., "Protein choices targeting thermogenesis and metabolism", Am J Clin Nutr 93:525-34 (2011).

(Continued)

*Primary Examiner* — Karlheinz R Skowronek
*Assistant Examiner* — Roy Teller
(74) *Attorney, Agent, or Firm* — Fenwick & West LLP

(57) ABSTRACT

Charged nutritive proteins are provided. In some embodiments the nutritive proteins an aqueous solubility of at least 12.5 g/L at pH 7. In some embodiments the nutritive proteins an aqueous solubility of at least 50 g/L at pH 7. In some embodiments the nutritive proteins an aqueous solubility of at least 100 g/L at pH 7. In some embodiments the nutritive proteins comprise at least one of a level of a) a ratio of branch chain amino acid residues to total amino acid residues present in the nutritive protein equal to or greater than the ratio of branch chain amino acid residues to total amino acid residues present in a benchmark protein; b) a ratio of leucine residues to total amino acid residues present in the nutritive protein equal to or greater than the ratio of leucine residues to total amino acid residues present in a benchmark protein; and c) a ratio of essential amino acid residues to total amino acid residues present in the nutritive protein equal to or greater than the ratio of essential amino acid residues to total amino acid residues present in a benchmark protein. Also provided are nucleic acids encoding the proteins, recombinant microorganisms that make the proteins, methods of making the proteins using recombinant microorganisms, compositions that comprise the proteins, and methods of using the proteins, among other things.

17 Claims, 1 Drawing Sheet

(56) References Cited

OTHER PUBLICATIONS

Akhavan T. et al., "Effect of premeal consumption of whey protein and its hydrolysate on food intake and postmeal glycemia and insulin responses in young adults", Am J Clin Nutr. 91(4):966-75 (Apr. 2010) (Epub Feb. 17, 2010).
Alfenas R. et al., "Effects of protein quality on appetite and energy metabolism in normal weight subjects", Arq Bras Endocrinol Metabol. 54 (1): 45-51; (2010).
Austin B. P. et al., "Hexahistidine-tagged maltose-binding protein as a fusion partner for the production of soluble recombinant proteins in *Escherichia coli*", Methods Mol. Biol. 498:157-72 (2009).
Avruch J. et al., "Amino acid regulation of TOR complex 1", Am J Physiol Endocrinol Metab. 296:E592-602. (2009).
Bai J. et al., "A gene optimization strategy that enhances production of fully functional P-Glycoprotein in *Pichia pastoris*", PLoS ONE 6(8):e22577 (2011).
Belza A. et al., "The beta-adrenergic antagonist propranolol partly abolishes thermogenic response to bioactive food ingredients", Metabolism. 58 (8):1137-44 (2009).
Borsheim E. et al., "Effect of amino acid supplementation on muscle mass, strength and physical function in elderly", Clin Nutr. 27:189-195 (2008).
Borsheim E. et al., "Essential amino acids and muscle protein recovery from resistance exercise", Am J Physiol Endocrinol Metab. 283:E648-E657 (2002).
Borsheim E. et al.,"Effect of amino acid supplementation on muscle mass, strength and physical function in elderly", Clin Nutr. 27: 189-95. (2008).
Børsheim E. et al., "Essential amino acids and muscle protein recovery from resistance exercise", Am J Physiol Metab. 283:E648-57 (2002).
Bossios A. et al., "Effect of simulated gastro-duodenal digestion on the allergenic reactivity of beta-lactoglobulin", Clin Transl Allergy. 1:6. (2011).
Breen L., Churchward-Venne T a., "Leucine: a nutrient "trigger" for muscle anabolism, but what more?" J Physiol. 590:2065-6. (2012).
Breen L., Phillips SM., "Skeletal muscle protein metabolism in the elderly: Interventions to counteract the "anabolic resistance" of ageing", Nutr Metab. Lond. 8:68. (2011).
Butts C. et al., "In vitro determination of dietary protein and amino acid digestibility for humans", Br J Nutr;108 Suppl :S282-7. (2012).
Dauncey M., Bingham S., "Dependence of 24 h energy expenditure in man on composition of the nutrient intake", Br J Nutr. 50:1-13 (1983).
Delaney B. et al., "Evaluation of protein safety in the context of agricultural biotechnology." Food. Chem. Toxicol. 46: S71-S97 (2008).
Deutz N.E.P. et al., "Muscle protein synthesis in cancer patients can be stimulated with a specially formulated medical food", Clin Nutr. 30:759-68. (2011).
Dreyer et al., "Leucine-enriched essential amino acid and carbohydrate ingestion following resistance exercise enhances mTOR signaling and protein synthesis in human muscle", Am. J. Physiol. Endocrinol. Metab. 294(2):E392-E400 (2008).
Dulloo A., "The search for compounds that stimulate thermogenesis in obesity management: from pharmaceuticals to functional food ingredients." Obes Rev. 12: 866-83 (2011).
Eastoe J. E., "The Amino Acid Composition of Mammalian Collagen and Gelatin", Biochem. J., vol. 61, pp. 589-600 (1955).
Elango R. et al., "Available versus digestible amino acids—new stable isotope methods", Br J Nutr.108 Suppl:S306-14. (2012).
Esmarck B. et al., "Timing of postexercise protein intake is important for muscle hypertrophy with resistance training in elderly humans", J Physiol. 535: 301-311. (2001).
Fernstrom J.D., Wolfe R.R., "Introduction to Symposium on Branched-Chain Amino Acids in Exercise", J Nutr.136:524S. (2006).
Ferrando A. et al., "EAA supplementation to increase nitrogen intake improves muscle function during bed rest in the elderly", Clin Nutr. 29:18-23. (2010).
Fromentin G. et al., "Peripheral and central mechanisms involved in the control of food intake by dietary amino acids and proteins", Nutr Res Rev. 25: 29-39. (2012).
Fujita et al., "Nutrient signaling in the regulation of human muscle protein synthesis", J. Physio. 582.2:813-23 (2007).
Goodman R. E. et al., "Allergenicity assessment of genetically modified crops—what makes sense?" Nature Biotechnology. pp. 73-81 (2008).
Gran P., Cameron-Smith D., "The actions of exogenous leucine on mTOR signalling and amino acid transporters in human myotubes", BMC Physiol. 11:10. (2011).
Hall W. L. et al., "Casein and whey exert different effects on plasma amino acid profiles, gastrointestinal hormone secretion and appetite", Br J Nutr. 89(2):239-48 (Feb. 2003).
Haran P. H. et al., "Role and potential mechanisms of anabolic resistance in sarcopenia", J Cachexia Sarcopenia Muscle (2012).
Herman R a. et al., "Digestion Assays in Allergenicity Assessment of Transgenic Proteins", Environ Health Perspect. 114:1154-7. (2006).
Holt C. et al., "Some physico-chemical properties of nine commercial or semi-commercial whey protein concentrates, isolates and fractions", Int J Food Sci Technol. 34:587-601. (1999).
Holt C. et al., "Apparent chemical composition of nine commercial or semi-commercial whey protein concentrates, isolates and fractions", Int J Food Sci Technol. 34:543-556. (1999).
Jenkins J. A. et al., "Evolutionary distance from human homologs reflects allergenicity of animal food proteins", J. Allergy Clin Immunol. 120: 1399-1405 (2007).
Kalogeropoulou D. et al., "Leucine, when ingested with glucose, synergistically stimulates insulin secretion and lowers blood glucose", Metabolism. 57:1747-52. (2008).
Katsanos C. S. et al., "A high proportion of leucine is required for optimal stimulation of the rate of muscle protein synthesis by essential amino acids in the elderly", Am J Physiol Metab. 291:E381-7. (2006).
Kong F., Singh R. P., "Disintegration of Solid Foods in Human Stomach," Journal of Food Science. pp. 67-80 (2008).
Koopman et al., "Co-ingestion of leucine with protein does not further augment post-exercise muscle protein synthesis rates in elderly men", Br. J. Nutr. 99:571-80 (2008).
Koopman et al., "Combined ingestion of protein and free leucine with carbohydrate increases postexercise muscle protein synthesis in vivo in male subjects", Am. J. Physiol. Endocrinol. Metab. 288:E645-643 (2005).
Kopf-bolanz K. A. et al., "Validation of an In Vitro Digestive System for Studying Macronutrient Decomposition" in 245-50. (2012).
Lorenzen J, et al. "The effect of milk proteins on appetite regulation and diet-induced thermogenesis", J Clin Nutr. 66 (5): 622-7. (2012).
Macauley-Patrick S. et al., "Heterologous protein production using the *Pichia pastoris* expression system", Yeast. 22:249-70. (2005).
Malakhov M. P.et al., "SUMO fusions and SUMO-specific protease for efficient expression and purification of proteins", J Struct Funct Genomics. 5(1-2):75-86 (2004).
Manders et al., "Co-ingestion of a protein hydrolysate and amino acid mixture with carbohydrate improves plasma glucose disposal in patients with type 2 diabetes", Am. J. Clin. Nutr. 82(1):76-83 (2005).
Martos G. et al., "Egg White Ovalbumin Digestion Mimicking Physiological Conditions." Journal of Agricultural and food chemistry. pp. 5640-5648 (2010).
Mikkelsen P. et al., "Effect of fat-reduced diets on 24 h energy expenditure: comparisons between animal protein, vegetable protein and carbohydrate", Am J Clin Nutr. 72:1135-41 (2000).
Moore D. et al., "Ingested protein dose response of muscle and albumin protein synthesis after resistance exercise in young men", Am J Clin Nutr. 89: 161-8. (2009).
Moreno F. J. et al., "Phospholipid interactions protect the milk allergen a-Lactalbumin from proteolysis during in vitro digestion", Journal of agricultural and food chemistry. pp. 9810-9816 (2005).
Moreno et al., "Stability of the major allergen Brazil nut 2S albumin (Ber e 1) to physiologically relevant in vitro gastrointestinal digestion", FEBS Journal. pp. 341-352. (2005).
Nicastro H. et al., "An overview of the therapeutic effects of leucine supplementation on skeletal muscle under atrophic conditions", Amino Acids;40:287-300. (2011).

(56) References Cited

OTHER PUBLICATIONS

Norton L. E. et al., "Leucine content of dietary proteins is a determinant of postprandial skeletal muscle protein synthesis in adult rats", Nutr Metab (Lond) 9:67. (2012).
Op den Kamp C. et al., "Muscle atrophy in cachexia: can dietary protein tip the balance?" Current Opinion in Clinical Nutrition and Metabolic Care. 12:611-616 (2009).
Paddon-Jones et al., "Essential amino acid and carbohydrate supplementation ameliorates muscle protein loss in humans during 28 days bed rest", J Clin Endocrinol Metab; 89:4351-435 (2004).
Paddon-Jones D. et al., "Nutritional Consequences of Critical Illness Myopathies Amino Acid Supplementation for Reversing Bed Rest and Steroid", J Nutr. 135:1809-12. (2005).
Panavas T. et al., "SUMO fusion technology for enhanced protein production in prokaryotic and eukaryotic expression systems", Methods Mol Biol. 497:303-17. (2009).
Pasiakos S. M., "Exercise and amino acid anabolic cell signaling and the regulation of skeletal muscle mass", Nutrients. 4:740-58. (2012).
Poon R. T-P. et al., "Long-term oral branched chain amino acids in patients undergoing chemoembolization for hepatocellular carcinoma: a randomized trial", Aliment Pharmacol Ther. 19:779-788. (2004).
Porro D. et al., "Production of recombinant proteins and metabolites in yeasts: when are these systems better than bacterial production systems?" Appl Microbiol Biotechnol. 89:939-48. (2011).
Punt P. J. et al., "Filamentous fungi as cell factories for heterologous protein production", Trends Biotechnol. 20:200-6. (2002).
Reddy I. M. et al., "Structural and conformational Basis of the Resistance of b-Lactoglobulin to Peptic and Chymotryptic Digestion", J. Agric. Food Chem. vol. 36. pp. 737-741 (1988).
Saitoh H. et al., "Strategies for the expression of SUMO-modified target proteins in *Escherichia coli*", Methods Mol. Biol. 497:211-21. (2009).
Sitkoff D. et al., "Accurate Calculation of Hydration Free Energies Using Macroscopic Solvent Models", J. Phys. Chem. 98 (1994).
Sun X., Zemel M. B., "Leucine and calcium regulate fat metabolism and energy partitioning in murine adipocytes and muscle cells", Lipids. 42:297-305. (2007).
Tang J. E., Phillips S. M., "Maximizing muscle protein anabolism: the role of protein quality", Curr Opin Clin Nutr Metab Care. 12:66-71. (2009).
Tappy L. et al., "Thermic effect of infused amino acids in healthy humans and in subjects with insulin resistance", Am J Clin Nutr. 57 (6): 912-6. (1993).
Tayek J. A. et al., "Improved protein kinetics and albumin synthesis by branched chain amino acid-enriched total parenteral nutrition in cancer cachexia", Cancer. 58:147-57 (1986).
Thomas K. et al., "Evaluating the effect of food processing on the potential human allergenicity of novel proteins: international workshop report.", Food Chem Toxicol. 45:1116-22. (2007).
Tipton K. D. et al., "Stimulation of muscle anabolism by resistance exercise and ingestion of leucine plus protein", Appl Physiol Nutr Metab. 34:151-61. (2009).
van Dijl J. M., Hecker M., "*Bacillus subtilis*: from soil bacterium to super-secreting cell factory", Microb Cell Fact.12:3. (2013).
Veldhorst M. A., "Dose-dependent satiating effect of whey relative to casein or soy", Physiol Behav. 96(4-5):675-82. (Mar. 23, 2009).
Volpi E. et al., "Essential amino acids are primarily responsible for the amino acid stimulation of muscle protein anabolism in healthy elderly adults", Am J Clin Nutr. 78:250-8. (2003).
Wolfe R. R., "Branched-Chain Amino Acids in Exercise Skeletal Muscle Protein Metabolism and Resistance Exercise", J Nutr. 525-8. (2006).
Wolfe R. R., "Regulation of Muscle Protein by Amino Acids", J Nutr. 132:3219S-3224S. (2002).
Xi P. et al, "Regulation of protein metabolism by glutamine: implications for nutrition and health", Front Biosci. 16:578-97. (2011).
GenBank Accession No. P13915 (Jan. 1, 1990).
GenBank Accession No. Q39817 (Jul. 15, 1998).
GenBank Accession No. O82709 (Dec. 1, 2000).
GenBank Accession No. P30236 (Apr. 1, 1993).
GenBank Accession No. Q29092 (Dec. 15, 1998).
GenBank Accession No. P19244 (Nov. 1, 1990).
GenBank Accession No. Q9TV61 (Feb. 6, 2007).
GenBank Accession No. Q9TV63 (Feb. 6, 2007).
GenBank Accession No. P15590 (Apr. 1, 1990).
GenBank Accession No. Q9TV62 (Feb. 6, 2007).
GenBank Accession No. Q9SP22 (Dec. 1, 2000).
GenBank Accession No. Q9SLY8 (Dec. 1, 2000).
GenBank Accession No. P86412 (Aug. 10, 2010).
GenBank Accession No. Q6YNX6 (Oct. 25, 2005).
GenBank Accession No. Q6YNX6 (Dec. 15, 1998).
GenBank Accession No. Q08275 (Feb. 1, 1995).
GenBank Accession No. P02547 (Jul. 21, 1986).
GenBank Accession No. Q6Z6L5 (Nov. 3, 2009).
GenBank Accession No. Q0JNS6 (Jul. 10, 2007).
GenBank Accession No. Q0DJV6 (Jun. 10, 2008).
GenBank Accession No. Q0IUU4 (Jun. 10, 2008).
GenBank Accession No. P62163 (Jun. 21, 2004).
GenBank Accession No. P04353 (Mar. 20, 1987).
GenBank Accession No. A2WN93 (Jul. 10, 2007).
GenBank Accession No. A2WNH1 (Jul. 10, 2007).
GenBank Accession No. P93087 (Jul. 15, 1998).
GenBank Accession No. Q7DMN9 (Nov. 23, 2004).
GenBank Accession No. P84339 (Feb. 1, 2005).
GenBank Accession No. P24632 (Mar. 1, 1992).
GenBank Accession No. Q5ZCK5 (Jun. 10, 2008).
GenBank Accession No. Q6ES52 (Jun. 15, 2010).
GenBank Accession No. P29269 (Dec. 1, 1992).
GenBank Accession No. P41040 (Feb. 1, 1995).
GenBank Accession No. P24631 (Mar. 1, 1992).
GenBank Accession No. Q6F332 (Jul. 25, 2006).
GenBank Accession No. Q0JNL7 (Jul. 10, 2007).
GenBank Accession No. Q0IQB6 (Jun. 10, 2008).
GenBank Accession No. A2Y609 (Jun. 10, 2008).
GenBank Accession No. Q40642 (Jun. 10, 2008).
GenBank Accession No. P04464 (Aug. 13, 1987).
GenBank Accession No. P48976 (Feb. 1, 1996).
GenBank Accession No. P27161 (Aug. 1, 1992).
GenBank Accession No. Q8S1Y9 (Jun. 10, 2008).
GenBank Accession No. P13868 (Jan. 1, 1990).
GenBank Accession No. P10246 (Jul. 1, 1989).
GenBank Accession No. P46254 (Nov. 1, 1995).
GenBank Accession No. Q84MN0 (Jun. 10, 2008).
GenBank Accession No. Q2R1Z5 (Jun. 10, 2008).
GenBank Accession No. P02540 (Jul. 21, 1986).
GenBank Accession No. P21753 (May 1, 1991).
GenBank Accession No. Q75ZZ6 (May 24, 2005).
GenBank Accession No. Q6DUB7 (Jan. 24, 2006).
GenBank Accession No. Q95274 (May 10, 2005).
GenBank Accession No. P58272 (Sep. 26, 2001).
GenBank Accession No. Q8S1Z1 (Apr. 4, 2003).
GenBank Accession No. B5X4E0 (Mar. 3, 2009).
GenBank Accession No. Q08655 (Oct. 1, 1994).
GenBank Accession No. Q10B98 (Sep. 2, 2008).
GenBank Accession No. Q6H7U2 (Sep. 2, 2008).
GenBank Accession No. P46618 (Nov. 1, 1995).
GenBank Accession No. P0C380 (May 29, 2007).
GenBank Accession No. P0C379 (May 29, 2007).
GenBank Accession No. P47815 (Feb. 1, 1996).
GenBank Accession No. Q29361 (Nov. 1, 1997).
GenBank Accession No. B5X186 (Mar. 3, 2009).
GenBank Accession No. P17703 (Aug. 1, 1990).
GenBank Accession No. B5DGI7 (Jul. 7, 2009).
GenBank Accession No. P37219 (Oct. 1, 1994).
GenBank Accession No. P0C470 (Jun. 12, 2007).
GenBank Accession No. P0C469 (Jun. 12, 2007).
GenBank Accession No. P69661 (Mar. 29, 2005).
GenBank Accession No. P42755 (Nov. 1, 1995).
GenBank Accession No. P12675 (Oct. 1, 1989).
GenBank Accession No. Q6ZK48 (May 29, 2007).
GenBank Accession No. A2YQU8 (May 29, 2007).
GenBank Accession No. Q0JHZ2 (Sep. 2, 2008).

(56) References Cited

OTHER PUBLICATIONS

GenBank Accession No. Q9M4U5 (Aug. 30, 2005).
GenBank Accession No. Q8LH03 (Mar. 2, 2010).
GenBank Accession No. P61268 (May 10, 2004).
GenBank Accession No. B5XCZ6 (Apr. 14, 2009).
GenBank Accession No. P56276 (Jul. 15, 1998).
GenBank Accession No. P14287 (Jan. 1, 1990).
GenBank Accession No. Q9MYT8 (Sep. 26, 2001).
GenBank Accession No. Q08000 (Nov. 1, 1995).
GenBank Accession No. Q29307 (Nov. 1, 1997).
GenBank Accession No. B5XGH3 (Mar. 24, 2009).
GenBank Accession No. Q9AS36 (May 15, 2007).
GenBank Accession No. O97965 (Sep. 27, 2004).
GenBank Accession No. Q2PMN9 (Oct. 31, 2006).
GenBank Accession No. Q6Q311 (Aug. 16, 2004).
GenBank Accession No. O04438 (Jan. 11, 2001).
GenBank Accession No. P22701 (Aug. 1, 1991).
GenBank Accession No. P83884 (May 10, 2004).
GenBank Accession No. P13618 (Jan. 1, 1990).
GenBank Accession No. Q65WT0 (Mar. 7, 2006).
GenBank Accession No. Q6K5K2 (Jun. 16, 2009).
GenBank Accession No. P12026 (Oct. 1, 1989).
GenBank Accession No. Q5KQI4 (Jun. 16, 2009).
GenBank Accession No. P04568 (Aug. 13, 1987).
GenBank Accession No. Q9XGX7 (Jan. 11, 2001).
GenBank Accession No. P46291 (Nov. 1, 1995).
GenBank Accession No. Q2MI43 (Oct. 31, 2006).
GenBank Accession No. Q69V36 (Jun. 16, 2009).
GenBank Accession No. P46517 (Nov. 1, 1995).
GenBank Accession No. Q9M314 (Aug. 29, 2001).
GenBank Accession No. P67985 (Oct. 11, 2004).
GenBank Accession No. P48504 (Feb. 1, 1996).
GenBank Accession No. Q94DE2 (Mar. 7, 2006).
GenBank Accession No. P12151(Oct. 1, 1989).
GenBank Accession No. P0C474(Jun. 12, 2007).
GenBank Accession No. A2XAM1(May 20, 2008).
GenBank Accession No. P46520(Nov. 1, 1995).
GenBank Accession No. P41101(Feb. 1, 1995).
GenBank Accession No. Q64L94(Nov. 9, 2004).
GenBank Accession No. Q10RE5(Jun. 12, 2007).
GenBank Accession No. A2XCT8(Jun. 12, 2007).
GenBank Accession No. Q7XNS7(Feb. 7, 2006).
GenBank Accession No. P49120(Feb. 1, 1996).
GenBank Accession No. Q41396(Jul. 15, 1998).
GenBank Accession No. Q2PMR3(Feb. 6, 2007).
GenBank Accession No. Q8L805(Apr. 13, 2004).
GenBank Accession No. P28520(Dec. 1, 1992).
GenBank Accession No. Q5JLY8(Jul. 25, 2006).
GenBank Accession No. O18734(Nov. 9, 2004).
GenBank Accession No. P49680(Feb. 1, 1996).
GenBank Accession No. Q8LJS2(Aug. 30, 2005).
GenBank Accession No. A7WLH8(Dec. 4, 2007).
GenBank Accession No. Q2MJV9(Nov. 28, 2006).
GenBank Accession No. A2XAM0(Apr. 29, 2008).
GenBank Accession No. A1L4T4(Jun. 12, 2007).
GenBank Accession No. A2Z7C4(Jun. 12, 2007).
GenBank Accession No. P55844(Nov. 1, 1997).
GenBank Accession No. A5YVD9(Jun. 16, 2009).
GenBank Accession No. P0CE66(Mar. 23, 2010).
GenBank Accession No. B7F6L8(Mar. 23, 2010).
GenBank Accession No. Q2VEC4(Jan. 24, 2006).
GenBank Accession No. Q943L2(Jul. 10, 2007).
GenBank Accession No. A2WWU2(Jul. 10, 2007).
GenBank Accession No. O65821(Jun. 27, 2006).
GenBank Accession No. Q2QWE9(May 20, 2008).
GenBank Accession No. Q9ZQW8(Sep. 2, 2008).
GenBank Accession No. Q43694(Nov. 2, 2001).
GenBank Accession No. A2ZIW7(May 20, 2008).
GenBank Accession No. P60099(Nov. 28, 2003).
GenBank Accession No. P60098(Nov. 28, 2003).
GenBank Accession No. B5XG43(Apr. 14, 2009).
GenBank Accession No. Q6ZBP3(Jul. 10, 2007).
GenBank Accession No. A2YWI3(Jul. 10, 2007).
GenBank Accession No. O49118(May 30, 2000).
GenBank Accession No. P27723(Aug. 1, 1992).
GenBank Accession No. P25461(May 1, 1992).
GenBank Accession No. O04433(Dec. 15, 1998).
GenBank Accession No. Q7XEJ5(Feb. 7, 2006).
GenBank Accession No. P62272(Jul. 5, 2004).
GenBank Accession No. A5JST6(Feb. 26, 2008).
GenBank Accession No. P08698(Jan. 1, 1988).
GenBank Accession No. A5A777(Apr. 29, 2008).
GenBank Accession No. P6290(Aug. 31, 2004).
GenBank Accession No. B5XG19(Jun. 16, 2009).
GenBank Accession No. A1Y2B7(May 20, 2008).
GenBank Accession No. Q2QLT8(Feb. 20, 2007).
GenBank Accession No. P46605(Nov. 1, 1995).
GenBank Accession No. Q8LNU5(Jul. 25, 2006).
GenBank Accession No. O24473(Jul. 15, 1998).
GenBank Accession No. P68211(Oct. 25, 2004).
GenBank Accession No. Q05462(Feb. 1, 1994).
GenBank Accession No. B5XBI1(May 31, 2011).
GenBank Accession No. Q43216(Jun. 13, 2006).
GenBank Accession No. O65818(Jun. 27, 2006).
GenBank Accession No. B5SNZ6(Mar. 24, 2009).
GenBank Accession No. P62262(Jul. 5, 2004).
GenBank Accession No. Q8LJU5(Jun. 21, 2004).
GenBank Accession No. Q5FZP5(Oct. 14, 2008).
GenBank Accession No. Q0JGY1(Sep. 11, 2007).
GenBank Accession No. Q29561(Nov. 1, 1997).
GenBank Accession No. Q8H2P8(Feb. 20, 2007).
GenBank Accession No. P55871(Nov. 1, 1997).
GenBank Accession No. P02632(Jul. 21, 1986).
GenBank Accession No. Q40703(Aug. 30, 2005).
GenBank Accession No. B5X7E4(May 31, 2011).
GenBank Accession No. Q941B1(Aug. 21, 2007).
GenBank Accession No. Q6B7M7(Oct. 11, 2004).
GenBank Accession No. P10668(Jul. 1, 1989).
GenBank Accession No. P30755(Jul. 1, 1993).
GenBank Accession No. A2WXX3(Sep. 11, 2007).
GenBank Accession No. A1XQU5(Jul. 24, 2007).
GenBank Accession No. Q08069(Feb. 1, 1996).
GenBank Accession No. Q712U6(May 16, 2006).
GenBank Accession No. P28807(Dec. 1, 1992).
GenBank Accession No. P80220(Oct. 1, 1993).
GenBank Accession No. P0C267(Dec. 12, 2006).
GenBank Accession No. Q2M177 (Feb. 6, 2007).
GenBank Accession No. Q2VEF5 (Feb. 6, 2007).
GenBank Accession No. Q2PMR2 (Feb. 6, 2007).
GenBank Accession No. P28803 (Dec. 1, 1992).
GenBank Accession No. Q5G6V9 (Sep. 13, 2005).
GenBank Accession No. A5YVF1 (May 20, 2008).
Accession No. P27807 (Aug. 1, 1992).
GenBank Accession No. Q41418 (Nov. 1, 1997).
GenBank Accession No. Q95H63 (Aug. 30, 2002).
GenBank Accession No. P02754 (Jul. 21, 1986).
GenBank Accession No. P02662 (Jul. 21, 1986).
GenBank Accession No. P29290 (Dec. 1, 1992).
GenBank Accession No. Q5ZMN0(Mar. 6, 2007).
GenBank Accession No. P35622 (Jun. 1, 1994).
GenBank Accession No. P02586 (Jul. 21, 1986).
GenBank Accession No. P63317 (Aug. 13, 1987).
GenBank Accession No. P63315 (Aug. 13, 1987).
GenBank Accession No. P60660 (Mar. 29, 2004).
GenBank Accession No. P02607 (Jul. 21, 1986).
GenBank Accession No. P02605 (Jul. 21, 1986).
GenBank Accession No. Q41784(Dec. 1, 2000).
GenBank Accession No. P02587 (Jul. 21, 1986).
GenBank Accession No. Q030J7 (Feb. 5, 2008).
GenBank Accession No. Q8DHS3 (Nov. 21, 2003).
GenBank Accession No. Q5FJI8 (Feb. 26, 2008).
GenBank Accession No. Q9WZD0 (Aug. 2, 2002).

(56) References Cited

OTHER PUBLICATIONS

GenBank Accession No. Q74IP1 (Feb. 26, 2008).
GenBank Accession No. P06787 (Jan. 1, 1988).
GenBank Accession No. P52193 (Oct. 1, 1996).
GenBank Accession No. P67975 (Jul. 21, 1986).
Cheng et al., "Protein Solubility and Differential Proteomic Profiling of Recombinant *Escherichia coli* Overexpressing Double-Tagged Fusion Proteins," Microbial Cell Factories, Aug. 28, 2010, pp. 63-75, vol. 9.
PCT International Search Report, PCT Application No. PCT/US13/71091, May 2, 2014, 25 pages.

\* cited by examiner

CHARGED NUTRITIVE PROTEINS AND METHODS

REFERENCE TO RELATED APPLICATION

This application claims priority to U.S. Provisional Patent Application No. 61/615,816, filed Mar. 26, 2012, which is hereby incorporated herein by reference in its entirety.

SEQUENCE LISTING

The instant application contains a Sequence Listing which has been submitted in ASCII format via EFS-Web and is hereby incorporated by reference in its entirety. Said ASCII copy, created on Mar. 12, 2013, is named 1005.004-US1 SL.txt and is 1,194,758 bytes in size.

INTRODUCTION

Dietary protein is an essential nutrient for human health and growth. The World Health Organization recommends that dietary protein should contribute approximately 10 to 15% of energy intake when in energy balance and weight stable. Average daily protein intakes in various countries indicate that these recommendations are consistent with the amount of protein being consumed worldwide. Meals with an average of 20 to 30% of energy from protein are representative of high-protein diets when consumed in energy balance.

The body cannot synthesize certain amino acids that are necessary for health and growth, and instead must obtain them from food. These amino acids, called "essential amino acids", are Histidine (H), Isoleucine (I), Leucine (L), Lysine (K), Methionine (M), Phenylalanine (F), Threonine (T), Tryptophan (W), and Valine (V). Dietary proteins that provide all the essential amino acids are referred to as "high quality" proteins. Animal foods such as meat, fish, poultry, eggs, and dairy products are generally regarded as high quality protein sources that provide a good balance of essential amino acids. Casein (a protein commonly found in mammalian milk, making up 80% of the proteins in cow milk) and whey (the protein in the liquid that remains after milk has been curdled and strained) are major sources of high quality dietary protein. Foods that do not provide a good balance of essential amino acids are referred to as "low quality" proteins. Most fruits and vegetables are poor sources of protein. Some plants foods including beans, peas, lentils, nuts and grains (such as wheat) are better sources of protein. Soy, a vegetable protein manufactured from soybeans, is considered by some to be a high quality protein.

Studies of the acute effects of consuming high amounts of protein in humans have shown that inclusion and in some cases increasing protein content in the diet can have beneficial effects. For example, studies have shown that ingestion of protein can induce postprandial satiety (including by suppressing hunger), induce thermogenesis and reduce glycemic response in human subjects.

Studies of high protein diets for weight loss have shown that protein positively affects energy expenditure and lean body mass. Further studies have shown that overeating produces significantly less weight gain in diets containing at least 5% of energy from protein, and that a high-protein diet decreases energy intake.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest increases lean body mass, improves functional measures of gait and balance, and may serve as a viable intervention for individuals at risk of sarcopenia due to immobility or prolonged bed rest.

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, milk proteins appear to be superior to soy in supporting muscle mass accretion with resistance training, while both are superior to carbohydrate alone. The amino acid leucine is an important factor in stimulating muscle protein synthesis.

Whole proteins commonly found in foods do not necessarily provide an amino acid composition that meets the amino acid requirements of a mammal, such as a human, in an efficient manner. The result is that, in order to attain the minimal requirements of each essential amino acid, a larger amount of total protein must be consumed in the diet than would be required if the quality of the dietary protein were higher. By increasing the quality of the protein in the diet it is possible to reduce the total amount of protein that must be consumed compared to diets that include lower quality proteins.

In general, proteins that have higher protein quality are considered more beneficial in a mammalian diet than other proteins that do not. Such proteins are useful, for example, as components of a mammalian diet. Under certain circumstances such proteins promote maintenance of muscle mass, a healthy body mass index, and glycemic balance, among other things. Accordingly, there is a need for sources of proteins that have high protein quality.

Traditionally, desirable mixtures of amino acids, such as mixtures comprising essential amino acids, have been provided by hydrolyzing a protein with relatively high levels of essential amino acids, such as whey protein, and/or by combining free amino acids in a mixture that optionally also includes a hydrolyzed protein such as whey. Mixtures of this type may have a bitter taste and may be deemed unsuitable or undesirable for certain uses. As a result, such mixtures sometimes include flavoring agents to mask the taste of the free amino acids and/or hydrolyzed protein. In some cases compositions in which a proportion of the amino acid content is provided by polypeptides or proteins are found to have a better taste than compositions with a high proportion of total amino acids provided as free amino acids and/or certain hydrolyzed proteins. The availability of such compositions has been limited, however, because nutritional formulations have traditionally been made from protein isolated from natural food products, such as whey isolated from milk, or soy protein isolated from soy. The amino acid profiles of those proteins do not necessarily meet the amino acid requirements for a mammal. In addition, commodity proteins typically consist of mixtures of proteins and/or protein hydrolysates which can vary in their protein composition, thus leading to unpredictability regarding their nutritional value. Moreover, the limited number of sources of such high quality proteins has meant that only certain combinations of amino acids are available on a large scale for ingestion in protein form.

The agricultural methods required to supply high quality animal protein sources such as casein and whey, eggs, and meat, as well as plant proteins such as soy, also require significant energy inputs and have potentially deleterious environmental impacts. Accordingly, it would be useful in certain situations to have alternative sources and methods of supplying proteins for mammalian consumption.

In theory, synthetic polypeptide sequences comprising a desired mixture of amino acids could be designed and produced in a laboratory setting. This approach may raise various concerns, however, and is therefore not always applicable. First, skilled artisans are aware that obtaining high levels of production of such synthetic sequences may be very challenging. Second, even if such a synthetic protein were synthesized, its suitability for use in a nutritive product would be uncertain. For example, such a non-naturally occurring polypeptide could be an allergen or a toxin. Accordingly, in some embodiments this disclosure provides natural protein or polypeptide sequences, or variants thereof.

One feature that can enhance the utility of a nutritive protein is its solubility. Nutritive proteins with higher solubility can exhibit desirable characteristics such as increased increased stability, resistance to aggregation, and desirable taste profiles. For example, a nutritive protein that exhibits enhanced solubility can be formulated into a beverage or liquid formulation that includes a high concentration of nutritive protein in a relatively low volume of solution, thus delivering a large dose of protein nutrition per unit volume. A soluble nutritive protein can be useful in sports drinks or recovery drinks wherein a user (e.g., an athlete) wants to ingest nutritive protein before, during or after physical activity. A nutritive protein that exhibits enhanced solubility can also be particularly useful in a clinical setting wherein a subject (e.g., a patient or an elderly person) is in need of protein nutrition but is unable to consume solid foods or large volumes of liquids.

This disclosure provides proteins composed of useful combinations of amino acids that do not rely solely on traditional agriculture for production. For example, the inventors have discovered and this disclosure provides naturally occurring polypeptide sequences composed of combinations of amino acids that contain a useful level of at least one of a ratio of branch chain amino acids to total amino acids, a ratio of the amino acid leucine to total amino acids, and a ratio essential amino acids to total amino acids. This disclosure also provides nutritive proteins comprising the polypeptide sequences. In some embodiments the nutritive proteins comprise at least one of a ratio of branch chain amino acid residues to total amino acid residues of at least 24%; a ratio of Leu residues to total amino acid residues of at least 11%; and a ratio of essential amino acid residues to total amino acid residues of at least 49%.

This disclosure also provides nucleic acids encoding the proteins, recombinant microorganisms that make the proteins, methods of making the proteins using recombinant microorganisms, compositions that comprise the proteins, and methods of using the proteins, among other things.

SUMMARY

In a first aspect this disclosure provides isolated nutritive proteins comprising a first polypeptide sequence, wherein the first polypeptide sequence has an aqueous solubility of at least 12.5 g/L at pH 7. In some embodiments the first polypeptide sequence has an aqueous solubility of at least 50 g/L at pH 7. In some embodiments the first polypeptide sequence has an aqueous solubility of at least 100 g/L at pH 7. In some embodiments the first polypeptide sequence comprises: a. a ratio of branch chain amino acid residues to total amino acid residues of at least 8%; b. a ratio of Leu residues to total amino acid residues of at least 4%; and c. a ratio of essential amino acid residues to total amino acid residues of at least 19%. In some embodiments the first polypeptide sequence further comprises at least one of each essential amino acid. In some embodiments the first polypeptide sequence comprises at least one of: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the first polypeptide sequence comprises at least 70% homology to at least 50 amino acids of a naturally occurring nutritive protein. In some embodiments the first polypeptide sequence comprises at least 95% homology to at least 50 amino acids of a naturally occurring nutritive protein. In some embodiments the first polypeptide sequence comprises at least 70% homology to a naturally occurring nutritive protein. In some embodiments the first polypeptide sequence comprises at least 95% homology to a naturally occurring nutritive protein.

In some embodiments the first polypeptide sequence consists of a naturally occurring nutritive protein. In some embodiments the first polypeptide sequence is not a naturally occurring nutritive protein.

In some embodiments the first polypeptide sequence is not an allergen. In some embodiments the first polypeptide sequence has less than 50% global homology to a known allergen.

In some embodiments the first polypeptide sequence is not a toxin. In some embodiments the first polypeptide sequence has less than 50% global homology to a known toxin.

In some embodiments the first polypeptide sequence has a simulated gastric digestion half-life of less than 60 minutes. In some embodiments the first polypeptide sequence has a simulated gastric digestion half-life of less than 30 minutes. In some embodiments the first polypeptide sequence has a simulated gastric digestion half-life of less than 10 minutes. In some embodiments the first polypeptide sequence is completely digested in simulated gastric fluid. In some embodiments the first polypeptide sequence comprises at least one protease recognition site selected from a pepsin recognition site, a trypsin recognition site, and a chymotrypsin recognition site. In some embodiments the first polypeptide sequence comprises no cysteine residues. In some embodiments the first polypeptide sequence comprises no disulfide bonds. In some embodiments the first polypeptide sequence does not comprise N-linked glycosylation. In some embodiments the first polypeptide sequence does not comprise O-linked glycosylation.

In some embodiments the first polypeptide sequence is resistant to aggregation. In some embodiments the first polypeptide sequence is anionic at pH 7. In some embodiments the first polypeptide sequence has a calculated solvation score of −20 or less. In some embodiments the first polypeptide sequence has a calculated solvation score of −30 or less. In some embodiments the first polypeptide sequence has a calculated aggregation score of 0.75 or less. In some embodiments the first polypeptide sequence has a calculated aggregation score of 0.5 or less. In some embodiments the first polypeptide sequence has a calculated aggregation score of 0.3 or less. In some embodiments the first polypeptide sequence comprises an amino acid sequence selected from: i. an amino acid sequence selected from SEQ ID NO: 1 to SEQ ID NO: 490; ii. a modified derivative of an amino acid sequence selected from SEQ ID NO: 1 to SEQ ID NO: 490; and iii. a mutein of an amino acid sequence selected from SEQ ID NO: 1 to SEQ ID NO: 490. In some embodiments the first polypeptide sequence consists of an amino acid sequence selected from: i. an amino acid sequence selected from SEQ ID NO: 1 to SEQ ID NO: 490, ii. a modified derivative of an amino acid sequence selected from SEQ ID NO: 1 to SEQ ID NO: 490, and iii. a mutein of an amino acid sequence selected from SEQ ID NO: 1 to SEQ ID NO: 490. In some embodiments the first polypeptide sequence is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one reference amino acid sequence selected from SEQ ID NO: 1 to SEQ ID NO: 490.

In another aspect this disclosure provides isolated nutritive proteins comprising a first polypeptide sequence, wherein the isolated nutritive protein has an aqueous solubility of at least 12.5 g/L at pH 7. In some embodiments the isolated nutritive protein has an aqueous solubility of at least 50 g/L at pH 7. In some embodiments the isolated nutritive protein has an aqueous solubility of at least 100 g/L at pH 7. In some embodiments the isolated nutritive protein comprises: a. a ratio of branch chain amino acid residues to total amino acid residues of at least 8%; b. a ratio of Leu residues to total amino acid residues of at least 4%; and c. a ratio of essential amino acid residues to total amino acid residues of at least 19%. In some embodiments the isolated nutritive protein further comprises at least one of each essential amino acid. In some embodiments In some embodiments the isolated nutritive protein comprises at least one of: a. a ratio of branch chain amino acid residues to total amino acid residues of at least 24%; b. a ratio of Leu residues to total amino acid residues of at least 11%; and c. a ratio of essential amino acid residues to total amino acid residues of at least 49%. In some embodiments the isolated nutritive protein comprises at least 70% homology to at least 50 amino acids of a naturally occurring nutritive protein. In some embodiments the isolated nutritive protein comprises at least 95% homology to at least 50 amino acids of a naturally occurring nutritive protein. In some embodiments the isolated nutritive protein comprises at least 70% homology to a naturally occurring nutritive protein. In some embodiments the isolated nutritive protein comprises at least 95% homology to a naturally occurring nutritive protein.

In some embodiments the isolated nutritive protein consists of a naturally occurring nutritive protein. In some embodiments the isolated nutritive protein is not a naturally occurring nutritive protein.

In some embodiments the isolated nutritive protein is not an allergen. In some embodiments the isolated nutritive protein has less than 50% global homology to a known allergen.

In some embodiments the isolated nutritive protein is not a toxin. In some embodiments the isolated nutritive protein has less than 50% global homology to a known toxin.

In some embodiments the nutritive protein has a simulated gastric digestion half-life of less than 60 minutes. In some embodiments the nutritive protein has a simulated gastric digestion half-life of less than 30 minutes. In some embodiments the isolated nutritive protein has a simulated gastric digestion half-life of less than 10 minutes. In some embodiments the isolated nutritive protein is completely digested in simulated gastric fluid. In some embodiments the isolated nutritive protein comprises at least one protease recognition site selected from a pepsin recognition site, a trypsin recognition site, and a chymotrypsin recognition site. In some embodiments the isolated nutritive protein comprises no cysteine residues. In some embodiments the isolated nutritive protein comprises no disulfide bonds. In some embodiments the isolated nutritive protein does not comprise N-linked glycosylation. In some embodiments the isolated nutritive protein does not comprise O-linked glycosylation.

In some embodiments the isolated nutritive protein is resistant to aggregation. In some embodiments the isolated nutritive protein is anionic at pH 7. In some embodiments the isolated nutritive protein has a calculated solvation score of −20 or less. In some embodiments the isolated nutritive protein has a calculated solvation score of −30 or less. In some embodiments the isolated nutritive protein has a calculated aggregation score of 0.75 or less. In some embodiments the isolated nutritive protein has a calculated aggregation score of 0.5 or less. In some embodiments the isolated nutritive protein has a calculated aggregation score of 0.3 or less.

In some embodiments the isolated nutritive protein comprises an amino acid sequence selected from: i. an amino acid sequence selected from SEQ ID NO: 1 to SEQ ID NO: 490; ii. a modified derivative of an amino acid sequence selected from SEQ ID NO: 1 to SEQ ID NO: 490; and iii. a mutein of an amino acid sequence selected from SEQ ID NO: 1 to SEQ ID NO: 490. In some embodiments the isolated nutritive protein consists of an amino acid sequence selected from: i. an amino acid sequence selected from SEQ ID NO: 1 to SEQ ID NO: 490, ii. a modified derivative of an amino acid sequence selected from SEQ ID NO: 1 to SEQ ID NO: 490, and iii. a mutein of an amino acid sequence selected from SEQ ID NO: 1 to SEQ ID NO: 490. In some embodiments the isolated nutritive protein is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one reference amino acid sequence selected from SEQ ID NO: 1 to SEQ ID NO: 490.

In some embodiments the isolated nutritive proteins of this disclosure further comprise a polypeptide tag for affinity purification. In some embodiments the tag for affinity purification is a polyhistidine-tag.

In another aspect, this disclosure provides isolated nucleic acids comprising a nucleic acid sequence that encodes a nutritive protein of this disclosure. In some embodiments the isolated nucleic acid is selected from genomic DNA, cDNA, sense RNA and antisense RNA. In some embodiments the isolated nucleic acid is genomic DNA. In some embodiments the isolated nucleic acid is cDNA. In some embodiments the isolated nucleic acid further comprises an expression control sequence operatively linked to the nucleic acid sequence that encodes the nutritive protein. In some embodiments a vector is provided that In another aspect, this disclosure provides a vector comprising a nucleic acid sequence that encodes a nutritive protein of this disclosure. In some embodiments the vector further comprises an expression control sequence operatively linked to the nucleic acid sequence that encodes the nutritive protein.

In another aspect, this disclosure provides recombinant microorganisms comprising at least one of a nucleic acid of this disclosure and a vector of this disclosure. In some embodiments the recombinant microorganism is a prokaryote. In some embodiments the prokaryote is heterotrophic. In some embodiments the prokaryote is autotrophic. In some embodiments the prokaryote is a bacteria.

In another aspect, this disclosure provides methods of making a nutritive protein of this disclosure, the method comprising culturing a recombinant microorganism of this disclosure under conditions sufficient for production of the nutritive protein by the recombinant microorganism. In some embodiments the methods further comprise isolating the nutritive protein from the culture.

In another aspect, this disclosure provides nutritive compositions comprising an isolated nutritive protein of this disclosure and at least one second component. In some embodiments the at least one second component is selected from a protein, a polypeptide, a peptide, a free amino acid, a carbohydrate, a lipid, a mineral or mineral source, a vitamin, a supplement, an organism, a pharmaceutical, and an excipient. In some embodiments the at least one second component is a protein. In some embodiments the at least one second component is a nutritive protein. In some embodiments the at least one second component is a free amino acid selected from essential amino acids, non-essential amino acids, branch chain amino acids, non-standard amino acids and modified amino acids. In some embodiments the at least one second component is a free amino acid selected from essential amino acids. In some embodiments the at least one second component is a free amino acid selected from branch chain amino acids. In some embodiments the at least one second component is Leu. In some embodiments the at least one second component is a lipid. In some embodiments the lipid is selected from a fat, oil, triglyceride, cholesterol, phospholipid, and fatty acid. In some embodiments the at least one second component is selected from a mineral and a vitamin. In some embodiments the at least one second component is a supplement. In some embodiments the at least one second component is an organism. In some embodiments the at least one second component is a pharmaceutical. In some embodiments the at least one second component is an excipient. In some embodiments the at least one excipient is selected from a buffering agent, a preservative, a stabilizer, a binder, a compaction agent, a lubricant, a dispersion enhancer, a disintegration agent, a flavoring agent, a sweetener, a coloring agent. In some embodiments the nutritive composition is formulated as a liquid solution, slurry, suspension, gel, paste, powder, or solid.

In another aspect, this disclosure provides methods of making a nutritive composition of this disclosure, comprising providing a nutritive protein of this disclosure and combining the nutritive protein with the at least one second component.

In another aspect, this disclosure provides methods of maintaining or increasing at least one of muscle mass, muscle strength, and functional performance in a subject, the method comprising providing to the subject a sufficient amount of a nutritive protein of this disclosure, a nutritive composition of this disclosure or a nutritive composition made by a method of this disclosure. In some embodiments the subject is at least one of elderly, critically-medically ill, and suffering from protein-energy malnutrition. In some embodiments the nutritive protein of this disclosure, nutritive composition of this disclosure or nutritive composition made by a method of this disclosure is consumed by the subject in coordination with performance of exercise. In some embodiments the subject is obese. In some embodiments the nutritive protein of this disclosure, nutritive composition of this disclosure or nutritive composition made by a method of this disclosure is consumed by the subject by an oral, enteral, or parenteral route.

In another aspect, this disclosure provides methods of maintaining or achieving a desirable body mass index in a subject, the method comprising providing to the subject a sufficient amount of a nutritive protein of this disclosure, a nutritive composition of this disclosure or a nutritive composition made by a method of this disclosure. In some embodiments the subject is at least one of elderly, critically-medically ill, and suffering from protein-energy malnutrition. In some embodiments the nutritive protein of this disclosure, nutritive composition of this disclosure or nutritive composition made by a method of this disclosure is consumed by the subject in coordination with performance of exercise. In some embodiments the subject is obese. In some embodiments the nutritive protein of this disclosure, nutritive composition of this disclosure or nutritive composition made by a method of this disclosure is consumed by the subject by an oral, enteral, or parenteral route.

In another aspect, this disclosure provides methods of providing protein to a subject with protein-energy malnutrition, the method comprising providing to the subject a sufficient amount of a nutritive protein of this disclosure, a nutritive composition of this disclosure or a nutritive composition made by a method of this disclosure. In some embodiments the nutritive protein of this disclosure, nutritive composition of this disclosure or nutritive composition made by a method of this disclosure is consumed by the subject in coordination with performance of exercise. In some embodiments the subject is obese. In some embodiments the nutritive protein of this disclosure, nutritive composition of this disclosure or nutritive composition made by a method of this disclosure is consumed by the subject by an oral, enteral, or parenteral route.

In another aspect, this disclosure provides methods of increasing thermogenesis in a subject, the method comprising providing to the subject a sufficient amount of a nutritive protein of this disclosure, a nutritive composition of this disclosure or a nutritive composition made by a method of this disclosure. In some embodiments the subject is obese. In some embodiments the nutritive protein of this disclosure, nutritive composition of this disclosure or nutritive composition made by a method of this disclosure is consumed by the subject in coordination with performance of exercise. In some embodiments the subject is obese. In some embodiments the nutritive protein of this disclosure, nutritive composition of this disclosure or nutritive composition made by a method of this disclosure is consumed by the subject by an oral, enteral, or parenteral route.

In another aspect, this disclosure provides methods of inducing at least one of a satiation response and a satiety response in a subject, the method comprising providing to the subject a sufficient amount of a nutritive protein of this disclosure, a nutritive composition of this disclosure or a nutritive composition made by a method of this disclosure. In some embodiments the subject is obese. In some embodiments the nutritive protein of this disclosure, nutritive composition of this disclosure or nutritive composition made by a method of this disclosure is consumed by the subject in coordination with performance of exercise. In some embodiments the subject is obese. In some embodiments the nutritive protein of this disclosure, nutritive composition of this disclosure or nutritive composition made by a method of this disclosure is consumed by the subject by an oral, enteral, or parenteral route.

In another aspect, this disclosure provides methods of treating at least one of cachexia, sarcopenia and frailty in a subject, the method comprising providing to the subject a sufficient amount of a nutritive protein of this disclosure, a nutritive composition of this disclosure or a nutritive composition made by a method of this disclosure. In some embodiments the subject is obese. In some embodiments the nutritive protein of this disclosure, nutritive composition of this disclosure or nutritive composition made by a method of this disclosure is consumed by the subject by an oral, enteral, or parenteral route.

DETAILED DESCRIPTION

Figure 1:
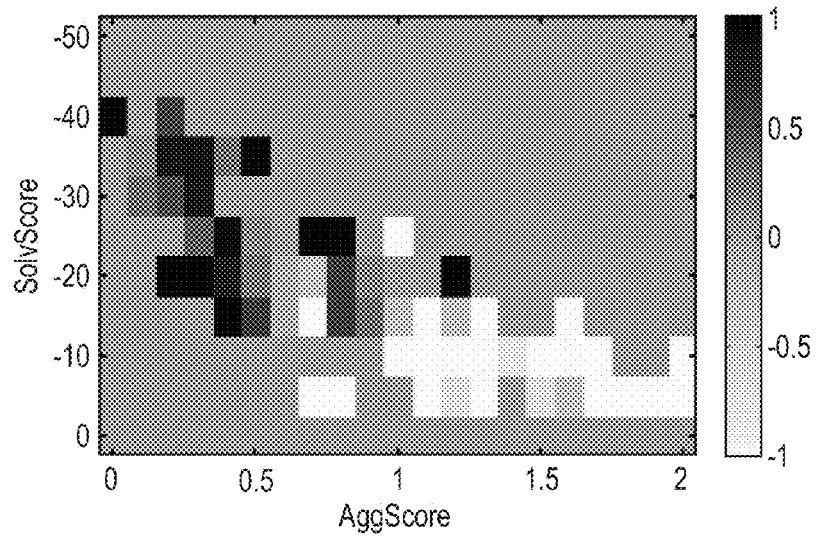
FIG. 1 shows a two dimensional histogram indicating the relative likelihood (on a log scale) of a protein being expressed in an *E. coli* expression screen as a function of solvation score (y-axis) and aggregation score (x-axis).

Unless otherwise defined herein, scientific and technical terms used in connection with the present disclosure shall have the meanings that are commonly understood by those of ordinary skill in the art. Further, unless otherwise required by context, singular terms shall include the plural and plural terms shall include the singular. Generally, nomenclatures used in connection with, and techniques of, biochemistry, enzymology, molecular and cellular biology, microbiology, genetics and protein and nucleic acid chemistry and hybridization described herein are those well-known and commonly used in the art. Certain references and other documents cited herein are expressly incorporated herein by reference. Additionally, all UniProt/SwissProt records cited herein are hereby incorporated herein by reference. In case of conflict, the present specification, including definitions, will control. The materials, methods, and examples are illustrative only and not intended to be limiting.

The methods and techniques of the present disclosure are generally performed according to conventional methods well known in the art and as described in various general and more specific references that are cited and discussed throughout the present specification unless otherwise indicated. See, e.g., Sambrook et al., Molecular Cloning: A Laboratory Manual, 3d ed., Cold Spring Harbor Laboratory Press, Cold Spring Harbor, N.Y. (2001); Ausubel et al., Current Protocols in Molecular Biology, Greene Publishing Associates (1992, and Supplements to 2002); Taylor and Drickamer, Introduction to Glycobiology, Oxford Univ. Press (2003); Worthington Enzyme Manual, Worthington Biochemical Corp., Freehold, N.J.; Handbook of Biochemistry: Section A Proteins, Vol I, CRC Press (1976); Handbook of Biochemistry: Section A Proteins, Vol II, CRC Press (1976); Essentials of Glycobiology, Cold Spring Harbor Laboratory Press (1999). Many molecular biology and genetic techniques applicable to cyanobacteria are described in Heidorn et al., "Synthetic Biology in Cyanobacteria: Engineering and Analyzing Novel Functions," Methods in Enzymology, Vol. 497, Ch. 24 (2011), which is hereby incorporated herein by reference.

This disclosure refers to sequence database entries (e.g., UniProt/SwissProt records) for certain protein and gene sequences that are published on the internet, as well as other information on the internet. The skilled artisan understands that information on the internet, including sequence database entries, is updated from time to time and that, for example, the reference number used to refer to a particular sequence can change. Where reference is made to a public database of sequence information or other information on the internet, it is understood that such changes can occur and particular embodiments of information on the internet can come and go. Because the skilled artisan can find equivalent information by searching on the internet, a reference to an internet web page address or a sequence database entry evidences the availability and public dissemination of the information in question.

Before the present proteins, compositions, methods, and other embodiments are disclosed and described, it is to be understood that the terminology used herein is for the purpose of describing particular embodiments only and is not intended to be limiting. It must be noted that, as used in the specification and the appended claims, the singular forms "a," "an" and "the" include plural referents unless the context clearly dictates otherwise.

The term "comprising" as used herein is synonymous with "including" or "containing", and is inclusive or open-ended and does not exclude additional, unrecited members, elements or method steps.

This disclosure makes reference to amino acids. The full name of the amino acids is used interchangeably with the standard three letter and one letter abbreviations for each. For the avoidance of doubt, those are: Alanine (Ala, A), Arginine (Arg, R), Asparagine (Asn, N), Aspartic acid (Asp, D), Cysteine (Cys, C), Glutamic Acid (Glu, E), Glutamine (Gln, Q), Glycine (Gly, G), Histidine (His, H), Isoleucine (Ile, I), Leucine (Leu, L), Lysine (Lys, K), Methionine (Met, M), Phenylalanine (Phe, F), Proline (Pro, P), Serine (Ser, S), Threonine (Thr, T), Tryptophan (Trp, W), Tyrosine (Tyr, Y), Valine (Val, V).

As used herein, the term "in vitro" refers to events that occur in an artificial environment, e.g., in a test tube or reaction vessel, in cell culture, in a Petri dish, etc., rather than within an organism (e.g., animal, plant, or microbe).

As used herein, the term "in vivo" refers to events that occur within an organism (e.g., animal, plant, or microbe).

As used herein, the term "isolated" refers to a substance or entity that has been (1) separated from at least some of the components with which it was associated when initially produced (whether in nature or in an experimental setting), and/or (2) produced, prepared, and/or manufactured by the hand of man. Isolated substances and/or entities may be separated from at least about 10%, about 20%, about 30%, about 40%, about 50%, about 60%, about 70%, about 80%, about 90%, or more of the other components with which they were initially associated. In some embodiments, isolated agents are more than about 80%, about 85%, about 90%, about 91%, about 92%, about 93%, about 94%, about 95%, about 96%, about 97%, about 98%, about 99%, or more than about 99% pure. As used herein, a substance is "pure" if it is substantially free of other components.

As used herein, a "branch chain amino acid" is an amino acid selected from Leucine, Isoleucine, and Valine.

As used herein, an "essential amino acid" is an amino acid selected from Histidine, Isoleucine, Leucine, Lysine, Methionine, Phenylalanine, Threonine, Tryptophan, and Valine.

The term "peptide" as used herein refers to a short polypeptide, e.g., one that typically contains less than about 50 amino acids and more typically less than about 30 amino acids. The term as used herein encompasses analogs and mimetics that mimic structural and thus biological function.

The term "polypeptide" encompasses both naturally-occurring and non-naturally occurring proteins, and fragments, mutants, derivatives and analogs thereof. A polypeptide may be monomeric or polymeric. Further, a polypeptide may comprise a number of different domains each of which has one or more distinct activities. For the avoidance of doubt, a "polypeptide" may be any length greater two amino acids.

The term "isolated protein" or "isolated polypeptide" is a protein or polypeptide that by virtue of its origin or source of derivation (1) is not associated with naturally associated components that accompany it in its native state, (2) exists in a purity not found in nature, where purity can be adjudged with respect to the presence of other cellular material (e.g., is free of other proteins from the same species) (3) is expressed by a cell from a different species, or (4) does not occur in nature (e.g., it is a fragment of a polypeptide found in nature or it includes amino acid analogs or derivatives not found in nature or linkages other than standard peptide bonds). Thus, a polypeptide that is chemically synthesized or synthesized in a cellular system different from the cell from which it naturally originates will be "isolated" from its naturally associated components. A polypeptide or protein may also be rendered substantially free of naturally associated components by isolation, using protein purification techniques well known in the art. As thus defined, "isolated" does not necessarily require that the protein, polypeptide, peptide or oligopeptide so described has been physically removed from a cell in which it was synthesized.

The term "polypeptide fragment" as used herein refers to a polypeptide that has a deletion, e.g., an amino-terminal and/or carboxy-terminal deletion compared to a full-length polypeptide, such as a naturally occurring protein. In an embodiment, the polypeptide fragment is a contiguous sequence in which the amino acid sequence of the fragment is identical to the corresponding positions in the naturally-occurring sequence. Fragments typically are at least 5, 6, 7, 8, 9 or 10 amino acids long, or at least 12, 14, 16 or 18 amino acids long, or at least 20 amino acids long, or at least 25, 30, 35, 40 or 45, amino acids, or at least 50 or 60 amino acids long, or at least 70 amino acids long, or at least 100 amino acids long.

The term "fusion protein" refers to a polypeptide comprising a polypeptide or fragment coupled to heterologous amino acid sequences. Fusion proteins are useful because they can be constructed to contain two or more desired functional elements that can be from two or more different proteins. A fusion protein comprises at least 10 contiguous amino acids from a polypeptide of interest, or at least 20 or 30 amino acids, or at least 40, 50 or 60 amino acids, or at least 75, 100 or 125 amino acids. The heterologous polypeptide included within the fusion protein is usually at least 6 amino acids in length, or at least 8 amino acids in length, or at least 15, 20, or 25 amino acids in length. Fusions that include larger polypeptides, such as an IgG Fc region, and even entire proteins, such as the green fluorescent protein ("GFP") chromophore-containing proteins, have particular utility. Fusion proteins can be produced recombinantly by constructing a nucleic acid sequence which encodes the polypeptide or a fragment thereof in frame with a nucleic acid sequence encoding a different protein or peptide and then expressing the fusion protein. Alternatively, a fusion protein can be produced chemically by crosslinking the polypeptide or a fragment thereof to another protein.

As used herein, a protein has "homology" or is "homologous" to a second protein if the nucleic acid sequence that encodes the protein has a similar sequence to the nucleic acid sequence that encodes the second protein. Alternatively, a protein has homology to a second protein if the two proteins have similar amino acid sequences. (Thus, the term "homologous proteins" is defined to mean that the two proteins have similar amino acid sequences.) As used herein, homology between two regions of amino acid sequence (especially with respect to predicted structural similarities) is interpreted as implying similarity in function.

When "homologous" is used in reference to proteins or peptides, it is recognized that residue positions that are not identical often differ by conservative amino acid substitutions. A "conservative amino acid substitution" is one in which an amino acid residue is substituted by another amino acid residue having a side chain (R group) with similar chemical properties (e.g., charge or hydrophobicity). In general, a conservative amino acid substitution will not substantially change the functional properties of a protein. In cases where two or more amino acid sequences differ from each other by conservative substitutions, the percent sequence identity or degree of homology may be adjusted upwards to correct for the conservative nature of the substitution. Means for making this adjustment are well known to those of skill in the art. See, e.g., Pearson, 1994, Methods Mol. Biol. 24:307-31 and 25:365-89.

The following six groups each contain amino acids that are conservative substitutions for one another: 1) Serine, Threonine; 2) Aspartic Acid, Glutamic Acid; 3) Asparagine, Glutamine; 4) Arginine, Lysine; 5) Isoleucine, Leucine, Methionine, Alanine, Valine, and 6) Phenylalanine, Tyrosine, Tryptophan.

Sequence homology for polypeptides, which is also referred to as percent sequence identity, is typically measured using sequence analysis software. See, e.g., the Sequence Analysis Software Package of the Genetics Computer Group (GCG), University of Wisconsin Biotechnology Center, 910 University Avenue, Madison, Wis. 53705. Protein analysis software matches similar sequences using a measure of homology assigned to various substitutions, deletions and other modifications, including conservative amino acid substitutions. For instance, GCG contains programs such as "Gap" and "Bestfit" which can be used with default parameters to determine sequence homology or sequence identity between closely related polypeptides, such as homologous polypeptides from different species of organisms or between a wild-type protein and a mutein thereof. See, e.g., GCG Version 6.1.

An exemplary algorithm when comparing a particular polypeptide sequence to a database containing a large number of sequences from different organisms is the computer program BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

Exemplary parameters for BLASTp are: Expectation value: 10 (default); Filter: seg (default); Cost to open a gap: 11 (default); Cost to extend a gap: 1 (default); Max. alignments: 100 (default); Word size: 11 (default); No. of descriptions: 100 (default); Penalty Matrix: BLOWSUM62. The length of polypeptide sequences compared for homology will generally be at least about 16 amino acid residues, or at least about 20 residues, or at least about 24 residues, or at least about 28 residues, or more than about 35 residues. When searching a database containing sequences from a large number of different organisms, it may be useful to compare amino acid sequences. Database searching using amino acid sequences can be measured by algorithms other than blastp known in the art. For instance, polypeptide sequences can be compared using FASTA, a program in GCG Version 6.1. FASTA provides alignments and percent sequence identity of the regions of the best overlap between the query and search sequences. Pearson, Methods Enzymol. 183:63-98 (1990). For example, percent sequence identity between amino acid sequences can be determined using FASTA with its default parameters (a word size of 2 and the PAM250 scoring matrix), as provided in GCG Version 6.1, herein incorporated by reference.

In some embodiments, polymeric molecules (e.g., a polypeptide sequence or nucleic acid sequence) are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% identical. In some embodiments, polymeric molecules are considered to be "homologous" to one another if their sequences are at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or at least 99% similar. The term "homologous" necessarily refers to a comparison between at least two sequences (nucleotides sequences or amino acid sequences). In some embodiments, two nucleotide sequences are considered to be homologous if the polypeptides they encode are at least about 50% identical, at least about 60% identical, at least about 70% identical, at least about 80% identical, or at least about 90% identical for at least one stretch of at least about 20 amino acids. In some embodiments, homologous nucleotide sequences are characterized by the ability to encode a stretch of at least 4-5 uniquely specified amino acids. Both the identity and the approximate spacing of these amino acids relative to one another must be considered for nucleotide sequences to be considered homologous. In some embodiments of nucleotide sequences less than 60 nucleotides in length, homology is determined by the ability to encode a stretch of at least 4-5 uniquely specified amino acids. In some embodiments, two protein sequences are considered to be homologous if the proteins are at least about 50% identical, at least about 60% identical, at least about 70% identical, at least about 80% identical, or at least about 90% identical for at least one stretch of at least about 20 amino acids.

As used herein, a "modified derivative" refers to polypeptides or fragments thereof that are substantially homologous in primary structural sequence to a reference polypeptide sequence but which include, e.g., in vivo or in vitro chemical and biochemical modifications or which incorporate amino acids that are not found in the reference polypeptide. Such modifications include, for example, acetylation, carboxylation, phosphorylation, glycosylation, ubiquitination, labeling, e.g., with radionuclides, and various enzymatic modifications, as will be readily appreciated by those skilled in the art. A variety of methods for labeling polypeptides and of substituents or labels useful for such purposes are well known in the art, and include radioactive isotopes such as $^{125}$I, $^{32}$P, $^{35}$S, and $^{3}$H, ligands that bind to labeled antiligands (e.g., antibodies), fluorophores, chemiluminescent agents, enzymes, and antiligands that can serve as specific binding pair members for a labeled ligand. The choice of label depends on the sensitivity required, ease of conjugation with the primer, stability requirements, and available instrumentation. Methods for labeling polypeptides are well known in the art. See, e.g., Ausubel et al., Current Protocols in Molecular Biology, Greene Publishing Associates (1992, and Supplements to 2002).

As used herein, "polypeptide mutant" or "mutein" refers to a polypeptide whose sequence contains an insertion, duplication, deletion, rearrangement or substitution of one or more amino acids compared to the amino acid sequence of a reference protein or polypeptide, such as a native or wild-type protein. A mutein may have one or more amino acid point substitutions, in which a single amino acid at a position has been changed to another amino acid, one or more insertions and/or deletions, in which one or more amino acids are inserted or deleted, respectively, in the sequence of the reference protein, and/or truncations of the amino acid sequence at either or both the amino or carboxy termini. A mutein may have the same or a different biological activity compared to the reference protein.

In some embodiments, a mutein has, for example, at least 85% overall sequence homology to its counterpart reference protein. In some embodiments, a mutein has at least 90% overall sequence homology to the wild-type protein. In other embodiments, a mutein exhibits at least 95% sequence identity, or 98%, or 99%, or 99.5% or 99.9% overall sequence identity.

As used herein, a "polypeptide tag for affinity purification" is any polypeptide that has a binding partner that can be used to isolate or purify a second protein or polypeptide sequence of interest fused to the first "tag" polypeptide. Several examples are well known in the art and include a His-6 tag, a FLAG epitope, a c-myc epitope, a Strep-TAGII, a biotin tag, a glutathione 5-transferase (GST), a chitin binding protein (CBP), a maltose binding protein (MBP), or a metal affinity tag.

As used herein, "recombinant" refers to a biomolecule, e.g., a gene or protein, that (1) has been removed from its naturally occurring environment, (2) is not associated with all or a portion of a polynucleotide in which the gene is found in nature, (3) is operatively linked to a polynucleotide which it is not linked to in nature, or (4) does not occur in nature. The term "recombinant" can be used in reference to cloned DNA isolates, chemically synthesized polynucleotide analogs, or polynucleotide analogs that are biologically synthesized by heterologous systems, as well as proteins and/or mRNAs encoded by such nucleic acids. Thus, for example, a protein synthesized by a microorganism is recombinant, for example, if it is synthesized from an mRNA synthesized from a recombinant gene present in the cell.

The term "polynucleotide", "nucleic acid molecule", "nucleic acid", or "nucleic acid sequence" refers to a polymeric form of nucleotides of at least 10 bases in length. The term includes DNA molecules (e.g., cDNA or genomic or synthetic DNA) and RNA molecules (e.g., mRNA or synthetic RNA), as well as analogs of DNA or RNA containing non-natural nucleotide analogs, non-native internucleoside bonds, or both. The nucleic acid can be in any topological conformation. For instance, the nucleic acid can be single-stranded, double-stranded, triple-stranded, quadruplexed, partially double-stranded, branched, hairpinned, circular, or in a padlocked conformation. The nucleic acid (also referred to as polynucleotides) may include both sense and antisense strands of RNA, cDNA, genomic DNA, and synthetic forms and mixed polymers of the above. They may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.) Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. Other modifications can include, for example, analogs in which the ribose ring contains a bridging moiety or other structure such as the modifications found in "locked" nucleic acids.

A "synthetic" RNA, DNA or a mixed polymer is one created outside of a cell, for example one synthesized chemically.

The term "nucleic acid fragment" as used herein refers to a nucleic acid sequence that has a deletion, e.g., a 5'-terminal or 3'-terminal deletion compared to a full-length reference nucleotide sequence. In an embodiment, the nucleic acid fragment is a contiguous sequence in which the nucleotide sequence of the fragment is identical to the corresponding positions in the naturally-occurring sequence. In some embodiments fragments are at least 10, 15, 20, or 25 nucleotides long, or at least 20, 30, 40, 50, 60, 70, 80, 90, 100, 110, 120, 130, 140, or 150 nucleotides long. In some embodiments a fragment of a nucleic acid sequence is a fragment of an open reading frame sequence. In some embodiments such a fragment encodes a polypeptide fragment (as defined herein) of the protein encoded by the open reading frame nucleotide sequence.

As used herein, an endogenous nucleic acid sequence in the genome of an organism (or the encoded protein product of that sequence) is deemed "recombinant" herein if a heterologous sequence is placed adjacent to the endogenous nucleic acid sequence, such that the expression of this endogenous nucleic acid sequence is altered. In this context, a heterologous sequence is a sequence that is not naturally adjacent to the endogenous nucleic acid sequence, whether or not the heterologous sequence is itself endogenous (originating from the same host cell or progeny thereof) or exogenous (originating from a different host cell or progeny thereof). By way of example, a promoter sequence can be substituted (e.g., by homologous recombination) for the native promoter of a gene in the genome of a host cell, such that this gene has an altered expression pattern. This gene would now become "recombinant" because it is separated from at least some of the sequences that naturally flank it.

A nucleic acid is also considered "recombinant" if it contains any modifications that do not naturally occur to the corresponding nucleic acid in a genome. For instance, an endogenous coding sequence is considered "recombinant" if it contains an insertion, deletion or a point mutation introduced artificially, e.g., by human intervention. A "recombinant nucleic acid" also includes a nucleic acid integrated into a host cell chromosome at a heterologous site and a nucleic acid construct present as an episome.

As used herein, the phrase "degenerate variant" of a reference nucleic acid sequence encompasses nucleic acid sequences that can be translated, according to the standard genetic code, to provide an amino acid sequence identical to that translated from the reference nucleic acid sequence. The term "degenerate oligonucleotide" or "degenerate primer" is used to signify an oligonucleotide capable of hybridizing with target nucleic acid sequences that are not necessarily identical in sequence but that are homologous to one another within one or more particular segments.

The term "percent sequence identity" or "identical" in the context of nucleic acid sequences refers to the residues in the two sequences which are the same when aligned for maximum correspondence. The length of sequence identity comparison may be over a stretch of at least about nine nucleotides, usually at least about 20 nucleotides, more usually at least about 24 nucleotides, typically at least about 28 nucleotides, more typically at least about 32, and even more typically at least about 36 or more nucleotides. There are a number of different algorithms known in the art which can be used to measure nucleotide sequence identity. For instance, polynucleotide sequences can be compared using FASTA, Gap or Bestfit, which are programs in Wisconsin Package Version 10.0, Genetics Computer Group (GCG), Madison, Wis. FASTA provides alignments and percent sequence identity of the regions of the best overlap between the query and search sequences. Pearson, Methods Enzymol. 183:63-98 (1990). For instance, percent sequence identity between nucleic acid sequences can be determined using FASTA with its default parameters (a word size of 6 and the NOPAM factor for the scoring matrix) or using Gap with its default parameters as provided in GCG Version 6.1, herein incorporated by reference. Alternatively, sequences can be compared using the computer program, BLAST (Altschul et al., J. Mol. Biol. 215:403-410 (1990); Gish and States, Nature Genet. 3:266-272 (1993); Madden et al., Meth. Enzymol. 266:131-141 (1996); Altschul et al., Nucleic Acids Res. 25:3389-3402 (1997); Zhang and Madden, Genome Res. 7:649-656 (1997)), especially blastp or tblastn (Altschul et al., Nucleic Acids Res. 25:3389-3402 (1997)).

The term "substantial homology" or "substantial similarity," when referring to a nucleic acid or fragment thereof, indicates that, when optimally aligned with appropriate nucleotide insertions or deletions with another nucleic acid (or its complementary strand), there is nucleotide sequence identity in at least about 76%, 80%, 85%, or at least about 90%, or at least about 95%, 96%, 97%, 98% or 99% of the nucleotide bases, as measured by any well-known algorithm of sequence identity, such as FASTA, BLAST or Gap, as discussed above.

Alternatively, substantial homology or similarity exists when a nucleic acid or fragment thereof hybridizes to another nucleic acid, to a strand of another nucleic acid, or to the complementary strand thereof, under stringent hybridization conditions. "Stringent hybridization conditions" and "stringent wash conditions" in the context of nucleic acid hybridization experiments depend upon a number of different physical parameters. Nucleic acid hybridization will be affected by such conditions as salt concentration, temperature, solvents, the base composition of the hybridizing species, length of the complementary regions, and the number of nucleotide base mismatches between the hybridizing nucleic acids, as will be readily appreciated by those skilled in the art. One having ordinary skill in the art knows how to vary these parameters to achieve a particular stringency of hybridization.

In general, "stringent hybridization" is performed at about 25° C. below the thermal melting point (Tm) for the specific DNA hybrid under a particular set of conditions. "Stringent washing" is performed at temperatures about 5° C. lower than the Tm for the specific DNA hybrid under a particular set of conditions. The Tm is the temperature at which 50% of the target sequence hybridizes to a perfectly matched probe. See Sambrook et al., Molecular Cloning: A Laboratory Manual, 2d ed., Cold Spring Harbor Laboratory Press, Cold Spring Harbor, N.Y. (1989), page 9.51. For purposes herein, "stringent conditions" are defined for solution phase hybridization as aqueous hybridization (i.e., free of formamide) in 6×SSC (where 20×SSC contains 3.0 M NaCl and 0.3 M sodium citrate), 1% SDS at 65° C. for 8-12 hours, followed by two washes in 0.2×SSC, 0.1% SDS at 65° C. for 20 minutes. It will be appreciated by the skilled worker that hybridization at 65° C. will occur at different rates depending on a number of factors including the length and percent identity of the sequences which are hybridizing.

As used herein, an "expression control sequence" refers to polynucleotide sequences which are necessary to affect the expression of coding sequences to which they are operatively linked. Expression control sequences are sequences which control the transcription, post-transcriptional events and translation of nucleic acid sequences. Expression control sequences include appropriate transcription initiation, termination, promoter and enhancer sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion. The nature of such control sequences differs depending upon the host organism; in prokaryotes, such control sequences generally include promoter, ribosomal binding site, and transcription termination sequence. The term "control sequences" is intended to encompass, at a minimum, any component whose presence is essential for expression, and can also encompass an additional component whose presence is advantageous, for example, leader sequences and fusion partner sequences.

As used herein, "operatively linked" or "operably linked" expression control sequences refers to a linkage in which the expression control sequence is contiguous with the gene of interest to control the gene of interest, as well as expression control sequences that act in trans or at a distance to control the gene of interest.

As used herein, a "vector" is intended to refer to a nucleic acid molecule capable of transporting another nucleic acid to which it has been linked. One type of vector is a "plasmid," which generally refers to a circular double stranded DNA loop into which additional DNA segments may be ligated, but also includes linear double-stranded molecules such as those resulting from amplification by the polymerase chain reaction (PCR) or from treatment of a circular plasmid with a restriction enzyme. Other vectors include cosmids, bacterial artificial chromosomes (BAC) and yeast artificial chromosomes (YAC). Another type of vector is a viral vector, wherein additional DNA segments may be ligated into the viral genome (discussed in more detail below). Certain vectors are capable of autonomous replication in a host cell into which they are introduced (e.g., vectors having an origin of replication which functions in the host cell). Other vectors can be integrated into the genome of a host cell upon introduction into the host cell, and are thereby replicated along with the host genome. Moreover, certain vectors are capable of directing the expression of genes to which they are operatively linked. Such vectors are referred to herein as "recombinant expression vectors" (or simply "expression vectors").

The term "recombinant host cell" (or simply "recombinant cell" or "host cell"), as used herein, is intended to refer to a cell into which a recombinant nucleic acid such as a recombinant vector has been introduced. In some instances the word "cell" is replaced by a name specifying a type of cell. For example, a "recombinant microorganism" is a recombinant host cell that is a microorganism host cell. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "recombinant host cell," "recombinant cell," and "host cell", as used herein. A recombinant host cell may be an isolated cell or cell line grown in culture or may be a cell which resides in a living tissue or organism.

As used herein, the term "heterotrophic" refers to an organism that cannot fix carbon and uses organic carbon for growth.

As used herein, the term "autotrophic" refers to an organism that produces complex organic compounds (such as carbohydrates, fats, and proteins) from simple inorganic molecules using energy from light (by photosynthesis) or inorganic chemical reactions (chemosynthesis).

As used herein, "muscle mass" refers to the weight of muscle in a subject's body. Muscle mass includes the skeletal muscles, smooth muscles (such as cardiac and digestive muscles) and the water contained in these muscles. Muscle mass of specific muscles can be determined using dual energy x-ray absorptiometry (DEXA) (Padden-Jones et al., 2004). Total lean body mass (minus the fat), total body mass, and bone mineral content can be measured by DEXA as well. In some embodiments a change in the muscle mass of a specific muscle of a subject is determined, for example by DEXA, and the change is used as a proxy for the total change in muscle mass of the subject. Thus, for example, if a subject consumes a nutritive protein as disclosed herein and experiences an increase over a period of time in muscle mass in a particular muscle or muscle group, it can be concluded that the subject has experienced an increase in muscle mass.

As used herein, a "muscle strength" refers to the amount of force a muscle can produce with a single maximal effort. There are two types of muscle strength, static strength and dynamic strength. Static strength refers to isometric contraction of a muscle, where a muscle generates force while the muscle length remains constant and/or when there is no movement in a joint. Examples include holding or carrying an object, or pushing against a wall. Dynamic strength refers to a muscle generating force that results in movement. Dynamic strength can be isotonic contraction, where the muscle shortens under a constant load or isokinetic contraction, where the muscle contracts and shortens at a constant speed. Dynamic strength can also include isoinertial strength.

Unless specified, "muscle strength" refers to maximum dynamic muscle strength. Maximum strength is referred to as "one repetition maximum" (1RM). This is a measurement of the greatest load (in kilograms) that can be fully moved (lifted, pushed or pulled) once without failure or injury. This value can be measured directly, but doing so requires that the weight is increased until the subject fails to carry out the activity to completion. Alternatively, 1RM is estimated by counting the maximum number of exercise repetitions a subject can make using a load that is less than the maximum amount the subject can move. Leg extension and leg flexion are often measured in clinical trials (Borsheim et al., "Effect of amino acid supplementation on muscle mass, strength and physical function in elderly," Clin Nutr 2008; 27:189-195; Paddon-Jones, et al., "Essential amino acid and carbohydrate supplementation ameliorates muscle protein loss in humans during 28 days bed rest," J Clin Endocrinol Metab 2004; 89:4351-4358).

As used herein, "functional performance" refers to a functional test that simulates daily activities. "Functional performance" is measured by any suitable accepted test, including timed-step test (step up and down from a 4 inch bench as fast as possible 5 times), timed floor transfer test (go from a standing position to a supine position on the floor and thereafter up to a standing position again as fast as possible for one repetition), and physical performance battery test (static balance test, chair test, and a walking test) (Borsheim et al., "Effect of amino acid supplementation on muscle mass, strength and physical function in elderly," Clin Nutr 2008; 27:189-195).

As used herein, a "body mass index" or "BMI" or "Quetelet index" is a subject's weight in kilograms divided by the square of the subject's height in meters ($kg/m^2$).

For adults, a frequent use of the BMI is to assess how much an individual's body weight departs from what is normal or desirable for a person of his or her height. The weight excess or deficiency may, in part, be accounted for by body fat, although other factors such as muscularity also affect BMI significantly. The World Health Organization regards a BMI of less than 18.5 as underweight and may indicate malnutrition, an eating disorder, or other health problems, while a BMI greater than 25 is considered overweight and above 30 is considered obese. (World Health Organization. BMI classification. Accessed Mar. 19, 2012 http://apps.who.int/bmi/ index.jsp?introPage=intro_3.html.) As used herein a "desirable body mass index" is a body mass index of from about 18.5 to about 25. Thus, if a subject has a BMI below about 18.5, then an increase in the subject's BMI is an increase in the desirability of the subject's BMI. If instead a subject has a BMI above about 25, then a decrease in the subject's BMI is an increase in the desirability of the subject's BMI.

As used herein, an "elderly" mammal is one who experiences age related changes in at least one of body mass index and muscle mass (e.g., age related sarcopenia). In some embodiments an "elderly" human is at least 50 years old, at least 60 years old, at least 65 years old, at least 70 years old, at least 75 years old, at least 80 years old, at least 85 years old, at least 90 years old, at least 95 years old, or at least 100 years old. In some embodiments and an elderly animal, mammal, or human is a human who has experienced a loss of muscle mass from peak lifetime muscle mass of at least 5%, at least 10%, at least 15%, at least 20%, at least 25%, at least 30%, at least 35%, at least 40%, at least 45%, at least 50%, at least 55%, or at least 60%. Because age related changes to at least one of body mass index and muscle mass are known to correlate with increasing age, in some embodiments an elderly mammal is identified or defined simply on the basis of age. Thus, in some embodiments an "elderly" human is identified or defined simply by the fact that their age is at least 60 years old, at least 65 years old, at least 70 years old, at least 75 years old, at least 80 years old, at least 85 years old, at least 90 years old, at least 95 years old, or at least 100 years old, and without recourse to a measurement of at least one of body mass index and muscle mass.

As used herein, a patient is "critically-medically ill" if the patient, because of medical illness, experiences changes in at least one of body mass index and muscle mass (e.g., sarcopenia). In some embodiments the patient is confined to bed for at least 25%, at least 50%, at least 60%, at least 70%, at least 80%, at least 90%, at least 95%, or 100% of their waking time. In some embodiments the patient is unconscious. In some embodiments the patient has been confined to bed as described in this paragraph for at least 1 day, 2 days, 3 days, 4 days, 5 days, 10 days, 2 weeks, 3 weeks, 4 weeks, 5 weeks, 10 weeks or longer.

As used herein, "protein-energy malnutrition" refers to a form of malnutrition where there is inadequate protein intake. Types include Kwashiorkor (protein malnutrition predominant), Marasmus (deficiency in both calorie and protein nutrition), and Marasmic Kwashiorkor (marked protein deficiency and marked calorie insufficiency signs present, sometimes referred to as the most severe form of malnutrition).

As used herein, "cachexia" refers to a multifaceted clinical syndrome that results in wasting and weight loss. It is a complex condition where protein catabolism exceeds protein anabolism, which makes muscle wasting a primary feature of the condition. In addition to the metabolic derangements in protein metabolism, it is also characterized by anorexia and inflammation. These derangements plus impaired protein metabolism are responsive to nutrition therapy to varying degrees.

As used herein, "thermogenesis" is the process of heat production in a mammal. Thermogenesis is accompanied by an increase in energy expenditure. Thermogenesis is specifically the energy burned following the metabolism of a food component (such as protein). This may also be referred to as the thermic effect of food. Total energy expenditure by an individual equals the sum of resting energy expenditure (energy consumed at rest in a fasting state to support basal metabolism), the thermic effect of food, and energy expenditure related to physical activity. Resting energy expenditure accounts for about 65-75% of total energy expenditure in humans. The amount and activity of muscle mass is one influencer of resting energy expenditure. Adequate protein consumption to support muscle also influences resting energy expenditure. The ingestion of protein tends to increase energy expenditure following a meal; this is the thermic effect of food. The thermic effect of food accounts for about 10% of total energy expenditure in humans. While this is a small proportion of total energy expenditure, small increases in this value can impact body weight. Protein has a higher thermic effect than fat or carbohydrate; this effect along with other metabolic influences of protein make it a useful substrate for weight control, diabetes management and other conditions.

As used herein, "satiation" is the act of becoming full while eating or a reduced desire to eat. This halts or diminishes eating.

As used herein, "satiety" is the act of remaining full after a meal which manifests as the period of no eating follow the meal.

As used herein, "exercise" is, most broadly, any bodily activity that enhances or maintains physical fitness and overall health and wellness. Exercise is performed for various reasons including strengthening muscles and the cardiovascular system, honing athletic skills, weight loss or maintenance, as well as for the purpose of enjoyment.

As used herein, a "sufficient amount" is an amount of a protein or polypeptide disclosed herein that is sufficient to cause a desired effect. For example, if an increase in muscle mass is desired, a sufficient amount is an amount that causes an increase in muscle mass in a subject over a period of time. A sufficient amount of a protein or polypeptide fragment can be provided directly, i.e., by administering the protein or polypeptide fragment to a subject, or it can be provided as part of a composition comprising the protein or polypeptide fragment. Modes of administration are discussed elsewhere herein.

As used herein, the term "mammal" refers to any member of the taxonomic class mammalia, including placental mammals and marsupial mammals. Thus, "mammal" includes humans, primates, livestock, and laboratory mammals. Exemplary mammals include a rodent, a mouse, a rat, a rabbit, a dog, a cat, a sheep, a horse, a goat, a llama, cattle, a primate, a pig, and any other mammal. In some embodiments, the mammal is at least one of a transgenic mammal, a genetically-engineered mammal, and a cloned mammal.

A. Nutritive Proteins

For the purposes of this disclosure, a "nutritive protein" is a protein that contains a desirable amount of essential amino acids. In some embodiments, the nutritive protein comprises at least 30% essential amino acids by weight. In some embodiments, the nutritive protein comprises at least 40% essential amino acids by weight. In some embodiments, the nutritive protein comprises at least 50% essential amino acids by weight. In some embodiments the nutritive protein comprises or consists of a protein or fragment of a protein that naturally occurs in an edible species. In its broadest sense, an "edible species" encompasses any species known to be eaten without deleterious effect by at least one type of mammal. A deleterious effect includes a poisonous effect and a toxic effect. In some embodiments an edible species is a species known to be eaten by humans without deleterious effect. Some edible species are an infrequent but known component of the diet of only a small group of a type of mammal in a limited geographic location while others are a dietary staple throughout much of the world. In other embodiments an edible species is one not known to be previously eaten by any mammal, but that is demonstrated to be edible upon testing.

Edible species include but are not limited to *Gossypium turneri, Pleurotus cornucopiae, Glycine max, Oryza sativa, Thunnus obesus, Abies bracteata, Acomys ignitus, Lathyrus aphaca, Bos gaurus, Raphicerus melanotis, Phoca groenlandica, Acipenser sinensis, Viverra tangalunga, Pleurotus sajorcaju, Fagopyrum tataricum, Pinus strobus, Ipomoea nil, Taxus cuspidata, Ipomoea wrightii, Mya arenaria, Actinidia deliciosa, Gazella granti, Populus tremula, Prunus domestica, Larus argentatus, Vicia villosa, Sargocentron punctatissimum, Silene latifolia, Lagenodelphis hosei, Spisula solidissima, Crossarchus obscurus, Phaseolus angularis, Lathyrus vestitus, Oncorhynchus gorbuscha, Alligator mississippiensis, Pinus halepensis, Larus canus, Brassica napus, Silene cucubalus, Phoca fasciata, Gazella bennettii, Pinus taeda, Taxus canadensis, Zamia furfuracea, Pinus yunnanensis, Pinus wallichiana, Asparagus officinalis, Capsicum baccatum, Pinus longaeva, Taxus baccata, Pinus sibirica, Citrus sinensis, Sargocentron xantherythrum, Bison bison, Gazella thomsonii, Vicia sativa, Branta canadensis, Apium graveolens, Acer campestre, Coriandrum sativum, Silene conica, Lactuca sativa, Capsicum chinense, Abies veitchii, Capra hircus, Gazella spekei, Oncorhynchus keta, Ipomoea obscura, Cucumis melo* var. *conomon, Phoca hispida, Vulpes vulpes, Ipomoea quamoclit, Solanum habrochaites, Populus* sp., *Pinus rigida, Quercus lyrata, Phaseolus coccineus, Larus ridibundus, Sargocentron spiniferum, Thunnus thynnus, Vulpes lagopus, Bos gaurus frontalis, Acer opalus, Acer palmatum, Quercus ilex, Pinus mugo, Grus antigone, Pinus uncinata, Prunus mume, Oncorhynchus tschawytscha, Gazella subgutturosa, Vulpes zerda, Pinus coulteri, Gossypium barbadense, Acer pseudoplatanus, Oncorhynchus nerka, Sus barbatus, Fagopyrum esculentum* subsp. *Ancestrale, Cynara cardunculus, Phaseolus aureus, Populus nigra, Gossypium schwendimanii, Solanum chacoense, Quercus rubra, Cucumis sativus, Equus burchelli, Oncorhynchus kisutch, Pinus radiata, Phoca vitulina richardsi, Grus nigricollis, Abies grandis, Oncorhynchus masou, Spinacia oleracea, Solanum chilense, Addax nasomaculatus, Ipomoea batatas, Equus grevyi, Abies sachalinensis, Pinus pinea, Hipposideros commersoni, Crocus nudiflorus, Citrus maxima, Acipenser transmontanus, Gossypium gossypioides, Viverra zibetha, Quercus cerris, Anser indicus, Pinus balfouriana, Silene otites, Oncorhynchus* sp., *Viverra megaspila, Bos mutus grunniens, Pinus elliottii, Equus hemionus kulan, Capra ibex ibex, Allium sativum, Raphanus sativus, Pinus echinata, Prunus serotina, Sargocentron diadema, Silene gallica, Brassica oleracea, Daucus carota, Oncorhynchus mykiss, Brassica oleracea* var. *alboglabra, Gossypium hirsutum, Abies alba, Citrus reticulata, Cichorium intybus, Bos sauveli, Lama glama, Zea mays, Acorus gramineus, Vulpes macrotis, Ovis ammon darwini, Raphicerus sharpei, Pinus contorta, Bos indicus, Capra sibirica, Pinus ponderosa, Prunus dulcis, Solanum sogarandinum, Ipomoea aquatica, Lagenorhynchus albirostris, Ovis canadensis, Prunus avium, Gazella dama, Thunnus alalunga, Silene pratensis, Pinus cembra, Crocus sativus, Citrullus lanatus, Gazella rufifrons, Brassica tournefortii, Capra falconeri, Bubalus mindorensis, Pinus palustris, Prunus laurocerasus, Grus vipio, Ipomoea purpurea, Pinus leiophylla, Lagenorhynchus obscurus, Raphicerus campestris, Brassica rapa* subsp. *Pekinensis, Acmella radicans, Ipomoea triloba, Pinus patula, Cucumis melo, Pinus virginiana, Solanum lycopersicum, Pinus densiflora, Pinus engelmannii, Quercus robur, Ipomoea setosa, Pleurotus djamor, Hipposideros diadema, Ovis aries, Sargocentron microstoma, Brassica oleracea* var. *italica, Capra cylindricornis, Populus kitakamiensis, Allium textile, Vicia faba, Fagopyrum esculentum, Bison priscus, Quercus suber, Lagophylla ramosissima, Acrantophis madagascariensis, Acipenser baerii, Capsicum annuum, Triticum aestivum, Xenopus laevis, Phoca sibirica, Acipenser naccarii, Actinidia chinensis, Ovis dalli, Solanum tuberosum, Bubalus carabanensis, Citrus jambhiri, Bison bonasus, Equus asinus, Bubalus depressicornis, Pleurotus eryngii, Solanum demissum, Ovis vignei, Zea mays* subsp. *Parviglumis, Lathyrus tingitanus, Welwitschia mirabilis, Grus rubicunda, Ipomoea coccinea, Allium cepa, Gazella soemmerringii, Brassica rapa, Lama vicugna, Solanum peruvianum, Xenopus borealis, Capra caucasica, Thunnus albacares, Equus zebra, Gallus gallus, Solanum bulbocastanum, Hipposideros terasensis, Lagenorhynchus acutus, Hippopotamus amphibius, Pinus koraiensis, Acer monspessulanum, Populus deltoides, Populus trichocarpa, Acipenser guldenstadti, Pinus thunbergii, Brassica oleracea* var. *capitata, Abyssocottus korotneffi, Gazella cuvieri, Abies homolepis, Abies holophylla, Gazella gazella, Pinus parviflora, Brassica oleracea* var. *acephala, Cucurbita pepo, Pinus armandii, Abies mariesii, Thunnus thynnus orientalis, Citrus unshiu, Solanum cheesmanii, Lagenorhynchus obliquidens, Acer platanoides, Citrus limon, Acrantophis dumerili, Solanum commersonii, Gossypium arboreum, Prunus persica, Pleurotus ostreatus, Abies firma, Gazella leptoceros, Salmo salar, Homarus americanus, Abies magnifica, Bos javanicus, Phoca largha, Sus cebifrons, Solanum melongena, Phoca vitulina, Pinus sylvestris, Zamia floridana, Vulpes corsac, Allium porrum, Phoca caspica, Vulpes chama, Taxus chinensis, Brassica oleracea* var. *botrytis, Anser anser anser, Phaseolus lunatus, Brassica campestris, Acer saccharum, Pinus pumila, Solanum pennellii, Pinus edulis, Ipomoea cordatotriloba, Populus alba, Oncorhynchus clarki, Quercus petraea, Sus verrucosus, Equus caballus przewalskii, Populus euphratica, Xenopus tropicalis, Taxus brevifolia, Lama guanicoe, Pinus banksiana, Solanum nigrum, Sus celebensis, Brassica juncea, Lagenorhynchus cruciger, Populus tremuloides, Pinus pungens, Bubalus quarlesi, Quercus gamelliflora, Ovis orientalis musimon, Bubalus bubalis, Pinus luchuensis, Sus philippensis, Phaseolus vulgaris, Salmo trutta, Acipenser persicus, Solanum brevidens, Pinus resinosa, Hippotragus niger, Capra nubiana, Asparagus scaber, Ipomoea platensis, Sus scrofa, Capra aegagrus, Lathyrus sativus, Sargocentron tiere, Hippoglossus hippoglossus, Acorus americanus, Equus caballus, Bos taurus, Barbarea vulgaris, Lama guanicoe pacos, Pinus pinaster, Octopus vulgaris, Solanum crispum, Hippotragus equinus, Equus burchellii antiquorum, Crossarchus alexandri, Ipomoea alba, Triticum monococcum, Populus jackii, Lagenorhynchus australis, Gazella dorcas, Quercus coccifera, Anser caerulescens, Acorus calamus, Pinus roxburghii, Pinus tabuliformis, Zamia fischeri, Grus carunculatus, Acomys cahirinus, Cucumis melo* var. *reticulatus, Gallus lafayettei, Pisum sativum, Pinus attenuata, Pinus clausa, Gazella saudiya, Capra ibex, Ipomoea trifida, Zea luxurians, Pinus krempfii, Acomys wilsoni, Petroselinum crispum, Quercus palustris, Triticum timopheevi, Meleagris gallopavo, Brassica oleracea, Brassica oleracea, Beta vulgaris, Solanum lycopersicum, Phaseolus vulgaris, Xiphias gladius, Morone saxatilis, Micropterus salmoides, Placopecten magellanicus, Sprattus sprattus, Clupea harengus, Engraulis encrasicolus, Cucurbita maxima, Agaricus bisporus, Musa acuminata* x *balbisiana, Malus domestica, Cicer arietinum, Anas platyrhynchos, Vaccinium macrocarpum, Rubus idaeus* x *strigosus, Vaccinium angustifolium, Fragaria ananassa, Rubus fruticosus, Cucumis melo, Ananas comosus, Cucurbita pepo, Cucurbita moschata, Sus scrofa domesticus, Ocimum basilicum, Rosmarinus officinalis, Foeniculum vulgare, Rheum rhabarbarum, Carica papaya,*

*Mangifera indica, Actinidia deliciosa, Prunus armeniaca, Prunus avium, Cocos nucifera, Olea europaea, Pyrus communis, Ficus carica, Passiflora edulis, Oryza sativa* subsp. *Japonica, Oryza sativa* subsp. Indica, *Coturnix coturnix, Saccharomyces cerevisiae*.

In some embodiments the nutritive protein comprises or consists of a derivative or mutein of a protein or fragment of a protein that naturally occurs in an edible species. Such a nutritive protein may be referred to as an "engineered nutritive protein." In such embodiments the natural protein or fragment thereof is a "reference" protein or polypeptide and the engineered nutritive protein or a first polypeptide sequence thereof comprises at least one sequence modification relative to the amino acid sequence of the reference protein or polypeptide. For example, in some embodiments the engineered nutritive protein or first polypeptide sequence thereof is at least 40%, 45%, 50%, 55%, 60%, 65%, 70%, 75%, 80%, 85%, 86%, 87%, 88%, 89%, 90%, 91%, 92%, 93%, 94%, 95%, 96%, 97%, 98%, 99%, or 99.5% homologous to at least one reference nutritive protein amino acid sequence. Typically the ratio of at least one of branch chain amino acid residues to total amino acid residues, essential amino acid residues to total amino acid residues, and leucine residues to total amino acid residues, present in the engineered nutritive protein or a first polypeptide sequence thereof is greater than the corresponding ratio of at least one of branch chain amino acid residues to total amino acid residues, essential amino acid residues to total amino acid residues, and leucine residues to total amino acid residues present in the reference nutritive protein or polypeptide sequence.

In some embodiments the nutritive protein is an abundant protein in food or a derivative or mutein thereof, or is a fragment of an abundant protein in food or a derivative or mutein thereof. An abundant protein is a protein that is present in a higher concentration in a food relative to other proteins present in the food. The food can be a known component of the diet of only a small group of a type of mammal in a limited geographic location, or a dietary staple throughout much of the world. In some embodiments the abundant protein in food is selected from chicken egg proteins such as ovalbumin, ovotransferrin, and ovomucuoid; meat proteins such as myosin, actin, tropomyosin, collagen, and troponin; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Three natural sources of protein generally regarded as good sources of high quality amino acids are whey protein, egg protein, and soy protein. Each source comprises multiple proteins. Table 1 presents the weight proportional representation of each amino acid in the protein source (g AA/g protein) expressed as a percentage.

TABLE 1

| Amino Acid | Whey | Egg | Soy |
| --- | --- | --- | --- |
| Isoleucine | 6.5% | 5.5% | 5.0% |
| Leucine | 11.0% | 8.6% | 8.0% |
| Lysine | 9.1% | 7.2% | 6.3% |
| Methionine | 2.1% | 3.1% | 1.3% |
| Phenylalanine | 3.4% | 5.3% | 1.2% |
| Threonine | 7.0% | 4.8% | 3.7% |
| Tryptophan | 1.7% | 1.2% | 1.3% |
| Valine | 6.2% | 6.1% | 4.9% |
| Histidine | 2.0% | 2.4% | 2.7% |
| Other | 51.7% | 49.5% | 60.4% |

Based on the percentages presented in Table 1, the weight proportion of each protein source that is essential amino acids, branched chain amino acids (L, I, and V), and leucine (L) is presented in Table 2.

TABLE 2

| Protein Source | Essential Amino Acids | Branch Chain Amino Acids | Leucine |
| --- | --- | --- | --- |
| Whey | 49.0% | 23.7% | 11.0% |
| Egg | 50.5% | 20.1% | 8.6% |
| Soy | 39.6% | 17.9% | 8.0% |

The sources relied on to determine the amino acid content of Whey are: Belitz H D., Grosch W., and Schieberle P. Food Chemistry (4th Ed). Springer-Verlag, Berlin Heidelberg 2009; http://www.gnc.com/product/index.jsp?productId=2986027; http://www.nutrabio.com/Products/whey_protein_concentrate.htm; and http://nutrabio.com/Products/whey_protein_isolate.htm. The amino acid content values from those sources were averaged to give the numbers presented in Tables 1 and 2. The source for soy protein is Egg, National Nutrient Database for Standard Reference, Release 24 (http://ndb.nal.usda.gov/ndb/foods/list). The source for soy protein is Self Nutrition Data (http://nutritiondata.self.com/facts/legumes-and-legume-products/4389/2).

As used herein, "whey protein" or "whey" means a protein mixture comprising an amino acid composition according to Tables 1 and 2. As used herein, whey protein comprises 49% essential amino acids, 24% branch chain amino acids, and 11% leucine, by weight.

As used herein, "egg protein" or "egg" means a protein mixture comprising an amino acid composition according to Tables 1 and 2. As used herein, egg protein comprises 51% essential amino acids, 20% branch chain amino acids, and 9% leucine, by weight.

As used herein, "soy protein" or "soy" means a protein mixture comprising an amino acid composition according to Tables 1 and 2. As used herein, soy protein comprises 40% essential amino acids, 18% branch chain amino acids, and 8% leucine, by weight.

Soluble nutritive proteins are particularly useful in some instances. A limitation of many proteins, including whey protein, egg protein, and soy protein, is that the proteins are not sufficiently soluble for certain purposes. In some embodiments this disclosure provides nutritive proteins that are more soluble than at least one of whey protein, egg protein, and soy protein.

One well characterized protein with a degree of solubility that is useful for certain purposes is gelatin. Commercial bone gelatin comprises 18% essential amino acids, 7.76% percent branch chain amino acids, and 3.45% leucine. (Eastow, J. E., "The Amino Acid Composition of Mammalian Collagen and Gelatin," Biochem. J., Vol. 61, pp. 589-600 (1955) As used herein, "gelatin protein" or "gelatin" means a protein mixture comprising 18% essential amino acids, 8% branch chain amino acids, and 4% leucine, by weight. Comparing these amino acid content numbers to whey protein, egg protein, and soy protein reveals that at least in the case of gelatin there is a tradeoff between solubility and nutritive amino acid content. In many embodiments this disclosure provides proteins that have a useful solubility profile and comprise at least one of 18% essential amino acids, 8% branch chain amino acids, and 4% leucine, by weight.

In some instances herein the portion of amino acid(s) of a particular type within a polypeptide, protein or a composition is quantified based on the weight proportion of the type of amino acid(s) to the total weight of amino acids present in the polypeptide, protein or composition in question. This value is calculated by dividing the weight of the particular amino acid(s) in the polypeptide, protein or a composition by the weight of all amino acids present in the polypeptide, protein or a composition.

In other instances the ratio of a particular type of amino acid(s) residues present in a polypeptide or protein to the total number of amino acids present in the polypeptide or protein in question is used. This value is calculated by dividing the number of the amino acid(s) in question that is present in each molecule of the polypeptide or protein by the total number of amino acid residues present in each molecule of the polypeptide or protein. A skilled artisan appreciates that these two methods are similar and that the weight proportion of a type of amino acid(s) present in a polypeptide or protein can be converted to a ratio of the particular type of amino acid residue(s), and vice versa.

In certain embodiments herein the weight proportion of branched chain amino acids, leucine, and/or essential amino acids in whey, egg, soy, or gelatin is used as a benchmark to measure the amino acid composition of a polypeptide, a protein, or a composition comprising at least one of a polypeptide and a protein. In those embodiments it is understood that the two measures are not completely equivalent, but it is also understood that the measures result in measurements that are similar enough to use for this purpose. For example, when a protein of interest is characterized as comprising a ratio of branch chain amino acid residues to total amino acid residues that is equal to or greater than 24% (the weight proportion of branch chain amino acid residues present in whey), that is a precise description of the branch chain amino acid content of the protein. At the same time, the weight proportion of branch chain amino acid residues present in that protein is not necessarily exactly equal to 24%. Even so, the skilled artisan understands that this is a useful comparison. If provided with the total number of amino acid residues present in the protein of interest the skilled artisan can also determine the weight proportion of branch chain amino acid residues in the protein of interest.

In some embodiments a nutritive protein according to this disclosure comprises a ratio of branch chain amino acid residues to total amino acid residues that is equal to or greater than the ratio of branch chain amino acid residues to total amino acid residues present in at least one of whey protein, egg protein, soy protein, and gelatin protein. Thus, in such embodiments the nutritive protein comprises a ratio of branch chain amino acid residues to total amino acid residues that is equal to or greater than a ratio selected from 24%, 20%, 18, and 8%.

In some embodiments a nutritive protein according to this disclosure comprises a ratio of L residues to total amino acid residues that is equal to or greater than the ratio of L residues to total amino acid residues present in at least one of whey protein, egg protein, and soy protein. Thus, in such embodiments the nutritive protein comprises a ratio of L residues to total amino acid residues that is equal to or greater than a ratio selected from 11%, 9%, 8, and 4%.

In some embodiments a nutritive protein according to this disclosure comprises a ratio of essential amino acid residues to total amino acid residues that is equal to or greater than the ratio of essential amino acid residues to total amino acid residues present in at least one of whey protein, egg protein, soy protein, and gelatin protein. Thus, in such embodiments the nutritive protein comprises a ratio of essential amino acid residues to total amino acid residues that is equal to or greater than a ratio selected from 49%, 51%, 40, and 18%.

In some embodiments the nutritive protein comprises a ratio of branch chain amino acid residues to total amino acid residues that is equal to or greater than the ratio of branch chain amino acid residues to total amino acid residues present in at least one of whey protein, egg protein, soy protein, and gelatin protein; and comprises a ratio of L residues to total amino acid residues that is equal to or greater than the ratio of L residues to total amino acid residues present in at least one of whey protein, egg protein, soy protein, and gelatin protein. In some such embodiments the nutritive protein further comprises a ratio of essential amino acid residues to total amino acid residues that is equal to or greater than the ratio of essential amino acid residues to total amino acid residues present in at least one of whey protein, egg protein, soy protein, and gelatin protein.

In some embodiments the nutritive protein comprises a ratio of branch chain amino acid residues to total amino acid residues equal to or greater than 24% and a ratio of L residues to total amino acid residues that is equal to or greater than 11%. In some such embodiments the nutritive protein further comprises a ratio of essential amino acid residues to total amino acid residues equal to or greater than 49%.

In some embodiments the nutritive protein comprises a ratio of branch chain amino acid residues to total amino acid residues equal to or greater than 20% and a ratio of L residues to total amino acid residues that is equal to or greater than 9%. In some such embodiments the nutritive protein further comprises a ratio of essential amino acid residues to total amino acid residues equal to or greater than 51%.

In some embodiments the nutritive protein comprises a ratio of branch chain amino acid residues to total amino acid residues equal to or greater than 18% and a ratio of L residues to total amino acid residues that is equal to or greater than 8%. In some such embodiments the nutritive protein further comprises a ratio of essential amino acid residues to total amino acid residues equal to or greater than 40%.

In some embodiments the nutritive protein comprises a ratio of branch chain amino acid residues to total amino acid residues equal to or greater than 8% and a ratio of L residues to total amino acid residues that is equal to or greater than 4%. In some such embodiments the nutritive protein further comprises a ratio of essential amino acid residues to total amino acid residues equal to or greater than 18%.

Solubility of nutritive proteins can be measured by any method known in the art. In some embodiments solubility is examined by centrifuge concentration followed by protein concentration assays. Samples of nutritive proteins in 20 mM HEPES pH 7.5 are tested for protein concentration according to protocols using two methods, Coomassie Plus (Bradford) Protein Assay (Thermo Scientific) and Bicinchoninic Acid (BCA) Protein Assay (Sigma-Aldrich). Based on these measurements 10 mg of protein is added to an Amicon Ultra 3 kDa centrifugal filter (Millipore). Samples are concentrated by centrifugation at 10,000×g for 30 minutes. The final, now concentrated, samples are examined for precipitated protein and then tested for protein concentration as above using two methods, Bradford and BCA.

In some embodiments the nutritive proteins have a final solubility limit of at least 5 g/L, 10 g/L, 20 g/L, 30 g/L, 40 g/L, 50 g/L, or 100 g/L at physiological pH. In some embodiments the nutritive proteins are greater than 50%, greater than 60%, greater than 70%, greater than 80%, greater than 90%, greater than 95%, greater than 96%, greater than 97%, greater than 98%, greater than 99%, or greater than 99.5% soluble with no precipitated protein observed at a concentration of greater than 5 g/L, or 10 g/L, or 20 g/L, or 30 g/L, or 40 g/L, or 50 g/L, or 100 g/L at physiological pH. In some embodiments, the solubility of the nutritive protein is higher than those typically reported in studies examining the solubility limits of whey (12.5 g/L; Pelegrine et al., Lebensm.-Wiss. U.-Technol. 38 (2005) 77-80) and soy (10 g/L; Lee et al., JAOCS 80(1) (2003) 85-90).

One feature that can enhance the utility of a nutritive protein is its charge (or per amino acid charge). Nutritive proteins with higher charge can in some embodiments exhibit desirable characteristics such as increased solubility, increased stability, resistance to aggregation, and desirable taste profiles. For example, a charged nutritive protein that exhibits enhanced solubility can be formulated into a beverage or liquid formulation that includes a high concentration of nutritive protein in a relatively low volume of solution, thus delivering a large dose of protein nutrition per unit volume. A charged nutritive protein that exhibits enhanced solubility can be useful, for example, in sports drinks or recovery drinks wherein a user (e.g., an athlete) wants to ingest nutritive protein before, during or after physical activity. A charged nutritive protein that exhibits enhanced solubility can also be particularly useful in a clinical setting wherein a subject (e.g., a patient or an elderly person) is in need of protein nutrition but is unable to ingest solid foods or large volumes of liquids.

For example, the net charge ($Charge_P$) of a polypeptide at pH 7 can be calculated using the following formula:

$$Charge_P = -0.002 - (C)(0.045) - (D)(0.999) - (E)(0.998) + (H)(0.091) + (K)(1.0) + (R)(1.0) - (Y)(-0.001)$$

where C is the number of cysteine residues, D is the number of aspartic acid residues, E is the number of glutamic acid residues, H is the number of histidine residues, K is the number of lysine residues, R is the number of arginine residues and Y is the number of tyrosine residues in the polypeptide. The per amino acid charge ($Charge_A$) of the polypeptide can be calculated by dividing the net charge ($Charge_e$) by the number of amino acid residues (N), i.e., $Charge_A = Charge_P/N$. (See Bassi S (2007), "A Primer on Python for Life Science Researchers." *PLoS Comput Biol* 3(11): e199. doi:10.1371/journal.pcbi.0030199).

One metric for assessing the hydrophilicity and potential solubility of a given protein is the solvation score. Solvation score is defined as the total free energy of solvation (i.e. the free energy change associated with transfer from gas phase to a dilute solution) for all amino acid side chains if each residue were solvated independently, normalized by the total number of residues in the sequence. The side chain solvation free energies are found computationally by calculating the electrostatic energy difference between a vacuum dielectric of 1 and a water dielectric of 80 (by solving the Poisson-Boltzmann equation) as well as the non-polar, Van der Waals energy using a linear solvent accessible surface area model (D. Sitkoff, K. A. Sharp, B. Honig. "Accurate Calculation of Hydration Free Energies Using Macroscopic Solvent Models". J. Phys. Chem. 98, 1994). For amino acids with ionizable sidechains (Arg, Asp, Cys, Glu, His, Lys and Tyr), an average solvation free energy is used based on the relative probabilities for each ionization state at the specified pH. Solvation scores start at 0 and continue into negative values, and the more negative the solvation score, the more hydrophilic and potentially soluble the protein is predicted to be. In some embodiments of a nutritive protein, the nutritive protein has a solvation score of −10 or less at pH 7. In some embodiments of a nutritive protein, the nutritive protein has a solvation score of −15 or less at pH 7. In some embodiments of a nutritive protein, the nutritive protein has a solvation score of −20 or less at pH 7. In some embodiments of a nutritive protein, the nutritive protein has a solvation score of −25 or less at pH 7. In some embodiments of a nutritive protein, the nutritive protein has a solvation score of −30 or less at pH 7. In some embodiments of a nutritive protein, the nutritive protein has a solvation score of −35 or less at pH 7. In some embodiments of a nutritive protein, the nutritive protein has a solvation score of −40 or less at pH 7.

The solvation score is a function of pH by virtue of the pH dependence of the molar ratio of undissociated weak acid ([HA]) to conjugate base ([$A^-$]) as defined by the Henderson-Hasselbalch equation:

$$pH = pKa + \log\left(\frac{[A^-]}{[HA]}\right)$$

All weak acids have different solvation free energies compared to their conjugate bases, and the solvation free energy used for a given residue when calculating the solvation score at a given pH is the weighted average of those two values.

Accordingly, in some embodiments of a nutritive protein, the nutritive protein has a solvation score of −10 or less at an acidic pH. In some embodiments of a nutritive protein, the nutritive protein has a solvation score of −15 or less at at an acidic pH. In some embodiments of a nutritive protein, the nutritive protein has a solvation score of −20 or less at an acidic pH. In some embodiments of a nutritive protein, the nutritive protein has a solvation score of −25 or less at an acidic pH. In some embodiments of a nutritive protein, the nutritive protein has a solvation score of −30 or less at an acidic pH. In some embodiments of a nutritive protein, the nutritive protein has a solvation score of −35 or less at an acidic pH. In some embodiments of a nutritive protein, the nutritive protein has a solvation score of −40 or less at acidic pH.

Accordingly, in some embodiments of a nutritive protein, the nutritive protein has a solvation score of −10 or less at a basic pH. In some embodiments of a nutritive protein, the nutritive protein has a solvation score of −15 or less at at a basic pH. In some embodiments of a nutritive protein, the nutritive protein has a solvation score of −20 or less at a basic pH. In some embodiments of a nutritive protein, the nutritive protein has a solvation score of −25 or less at a basic pH. In some embodiments of a nutritive protein, the nutritive protein has a solvation score of −30 or less at a basic pH. In some embodiments of a nutritive protein, the nutritive protein has a solvation score of −35 or less at a basic pH. In some embodiments of a nutritive protein, the nutritive protein has a solvation score of −40 or less at basic pH.

Accordingly, in some embodiments of a nutritive protein, the nutritive protein has a solvation score of −10 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −15 or less at at a pH range selected from 2-3, 3-4, 4-5, 5-6, 6-7, 7-8, 8-9, 9-10, 10-11, and 11-12. In some embodiments of a nutritive protein, the nutritive protein has a solvation score of −20 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −25 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −30 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −35 or less at a pH range selected from 2-3, 3-4, 4-5, 5-6, 6-7, 7-8, 8-9, 9-10, 10-11, and 11-12. In some embodiments of a nutritive protein, the nutritive protein has a solvation score of −40 or less at a pH range selected from 2-3, 3-4, 4-5, 5-6, 6-7, 7-8, 8-9, 9-10, 10-11, and 11-12.

The aggregation score is a primary sequence based metric for assessing the hydrophobicity and likelihood of aggregation of a given protein. Using the Kyte and Doolittle hydrophobity scale (Kyte J, Doolittle R F (May 1982) "A simple method for displaying the hydropathic character of a protein". *J. Mol. Biol.* 157 (1): 105-32), which gives hydrophobic residues positive values and hydrophilic residues negative values, the average hydrophobicity of a protein sequence is calculated using a moving average of five residues. The aggregation score is drawn from the resulting plot by determining the area under the curve for values greater than zero and normalizing by the total length of the protein. The underlying hypothesis is that aggregation is the result of two or more hydrophobic patches coming together to exclude water and reduce surface exposure, and the likelihood that a protein will aggregate is a function of how densely packed its hydrophobic (i.e., aggregation prone) residues are. Aggregation scores start at 0 and continue into positive values, and the smaller the aggregation score, the less hydrophobic and potentially less prone to aggregation the protein is predicted to be. In some embodiments of a nutritive protein, the nutritive protein has an aggregation score of 2 or less. In some embodiments of a nutritive protein, the nutritive protein has an aggregation score of 1.5 or less. In some embodiments of a nutritive protein, the nutritive protein has an aggregation score of 1 or less. In some embodiments of a nutritive protein, the nutritive protein has an aggregation score of 0.9 or less. In some embodiments of a nutritive protein, the nutritive protein has an aggregation score of 0.8 or less. In some embodiments of a nutritive protein, the nutritive protein has an aggregation score of 0.7 or less. In some embodiments of a nutritive protein, the nutritive protein has an aggregation score of 0.6 or less. In some embodiments of a nutritive protein, the nutritive protein has an aggregation score of 0.5 or less. In some embodiments of a nutritive protein, the nutritive protein has an aggregation score of 0.4 or less. In some embodiments of a nutritive protein, the nutritive protein has an aggregation score of 0.3 or less. In some embodiments of a nutritive protein, the nutritive protein has an aggregation score of 0.2 or less. In some embodiments of a nutritive protein, the nutritive protein has an aggregation score of 0.1 or less.

In some cases, soluble expression is desirable because it can increase the amount and/or yield of the nutritive protein and facilitate one or more of the isolation and purification of the nutritive protein. In some embodiments, the nutritive proteins of this disclosure are solubly expressed in the host organism. Solvation score and aggregation score can be used to predict soluble expression of recombinant nutritive proteins in a host organism. As shown in Example 8, this disclosure provides evidence suggesting that nutritive proteins with solvation scores of ≤−20 and aggregation scores of ≤0.75 are more likely to be recombinantly expressed in a particular *E. coli* expression system. Moreover, the data also suggests that nutritive proteins with solvation scores of ≤−20 and aggregation scores of ≤0.5 are more likely to be solubly expressed in this system. Therefore, in some embodiments the nutritive protein of this disclosure has a solvation score of −20 or less. In some embodiments the nutritive protein has an aggregation score of 0.75 or less. In some embodiments the nutritive protein has an aggregation score of 0.5 or less. In some embodiments the nutritive protein has a solvation score of −20 or less and an aggregation score of 0.75 or less. In some embodiments the nutritive protein has a solvation score of −20 or less and an aggregation score of 0.5 or less.

In some embodiments the nutritive protein is selected from SEQ ID NO: 1 to 490. In some embodiments the nutritive protein is selected from a modified derivative of SEQ ID NO: 1 to 490. In some embodiments the nutritive protein is selected from a mutein of SEQ ID NO: SEQ ID NO: 1 to 490.

In some embodiments the nutritive protein is a nutritive protein other than at least one nutritive protein selected from egg proteins such as ovalbumin, ovotransferrin, and ovomucuoid; meat proteins such as myosin, actin, tropomyosin, collagen, and troponin; milk proteins such as whey and casein; cereal proteins such as casein, alpha1 casein, alpha2 casein, beta casein, kappa casein, beta-lactoglobulin, alpha-lactalbumin, glycinin, beta-conglycinin, glutelin, prolamine, gliadin, glutenin, albumin, globulin; chicken muscle proteins such as albumin, enolase, creatine kinase, phosphoglycerate mutase, triosephosphate isomerase, apolipoprotein, ovotransferrin, phosphoglucomutase, phosphoglycerate kinase, glycerol-3-phosphate dehydrogenase, glyceraldehyde 3-phosphate dehydrogenase, hemoglobin, cofilin, glycogen phosphorylase, fructose-1,6-bisphosphatase, actin, myosin, tropomyosin a-chain, casein kinase, glycogen phosphorylase, fructose-1,6-bisphosphatase, aldolase, tubulin, vimentin, endoplasmin, lactate dehydrogenase, destrin, transthyretin, fructose bisphosphate aldolase, carbonic anhydrase, aldehyde dehydrogenase, annexin, adenosyl homocysteinase; pork muscle proteins such as actin, myosin, enolase, titin, cofilin, phosphoglycerate kinase, enolase, pyruvate dehydrogenase, glycogen phosphorylase, triosephosphate isomerase, myokinase; and fish proteins such as parvalbumin, pyruvate dehydrogenase, desmin, and triosephosphate isomerase.

Phenylketonuria (PKU) is an autosomal recessive metabolic genetic disorder characterized by a mutation in the gene for the hepatic enzyme phenylalanine hydroxylase (PAH), rendering it nonfunctional. This enzyme is necessary to metabolize phenylalanine to tyrosine. When PAH activity is reduced, phenylalanine accumulates and is converted into phenylpyruvate (also known as phenylketone), which is detected in the urine. Untreated children are normal at birth, but fail to attain early developmental milestones, develop microcephaly, and demonstrate progressive impairment of cerebral function. Hyperactivity, EEG abnormalities and seizures, and severe learning disabilities are major clinical problems later in life. A characteristic odor of skin, hair, sweat and urine (due to phenylacetate accumulation); and a tendency to hypopigmentation and eczema are also observed. All PKU patients must adhere to a special diet low in Phe. Accordingly, nutritive proteins comprising a low number or no Phe residues are desirable for PKU patients. Such proteins can be obtained by selecting nutritive proteins provided herein that have few or no Phe residues. Accordingly, in some embodiments the nutritive protein comprises a ratio of Phe residues to total amino acid residues equal to or lower than 5%, 4%, 3%, 2%, or 1%. In some embodiments the nutritive protein comprises 10 or fewer Phe residues, 9 or fewer Phe residues, 8 or fewer Phe residues, 7 or fewer Phe residues, 6 or fewer Phe residues, 5 or fewer Phe residues, 4 or fewer Phe residues, 3 or fewer Phe residues, 2 or fewer Phe residues, 1 Phe residue, or no Phe residues. In some embodiments, the nutritive protein comprises no Phe residues.

Arginine is a conditionally nonessential amino acid, meaning most of the time it can be manufactured by the human body, and does not need to be obtained directly through the diet. Individuals who have poor nutrition, the elderly, or people with certain physical conditions (e.g., sepsis) may not produce sufficient amounts of arginine and therefore need to increase their intake of foods containing arginine. Arginine is believed to have beneficial health properties, including reducing healing time of injuries (particularly bone), and decreasing blood pressure, particularly high blood pressure during high risk pregnancies (pre-eclampsia). In addition, studies have shown that dietary supplementation with L-arginine is beneficial for enhancing the reproductive performance of pigs with naturally occurring in-trauterine growth retardation, enhancing protein deposition and postnatal growth of milk-fed piglets, normalizing plasma glucose levels in streptozotocin-induced diabetic rats, reducing fat mass in obese Zucker diabetic fatty (ZDF) rats, and improving vascular function in diabetic rats. In order to combine these benefits with at least one utility of the nutritive proteins disclosed herein, in some embodiments of the nutritive proteins disclosed herein the nutritive protein comprises a ration of Arginine residues to total amino acid residues in the nutritive protein of equal to or greater than 3%, equal to or greater than 4%, equal to or greater than 5%, equal to or greater than 6%, equal to or greater than 7%, equal to or greater than 8%, equal to or greater than 9%, equal to or greater than 10%, equal to or greater than 11%, or equal to or greater than 12%.

Digestibility is a parameter relevant to the nutritive benefits and utility of nutritive proteins. Information relating to the relative completeness of digestion can serve as a predictor of peptide bioavailability (Daniel, H., 2003. Molecular and Integrative Physiology of Intestinal Peptide Transport. *Annual Review of Physiology*, Volume 66, pp. 361-384). In some embodiments nutritive proteins disclosed herein are screened to assess their digestibility. Digestibility of nutritive proteins can be assessed by any suitable method known in the art. In some embodiments digestability is assessed by a physiologically relevant in vitro digestion reaction that includes one or both phases of protein digestion, simulated gastric digestion and simulated intestinal digestion (see, e.g., Moreno, et al., 2005. Stability of the major allergen Brazil nut 2S albumin (Ber e 1) to physiologically relevant in vitro gastrointestinal digestion. *FEBS Journal*, pp. 341-352; Martos, G., Contreras, P., Molina, E. & Lopez-Fandino, R., 2010. Egg White Ovalbumin Digestion Mimicking Physiological Conditions. *Journal of Agricultural and food chemistry*, pp. 5640-5648; Moreno, F. J., Mackie, A. R. & Clare Mills, E. N., 2005. Phospholipid interactions protect the milk allergen a-Lactalbumin from proteolysis during in vitro digestion. *Journal of agricultural and food chemistry*, pp. 9810-9816). Briefly, test proteins are sequentially exposed to a simulated gastric fluid (SGF) for 120 minutes (the length of time it takes 90% of a liquid meal to pass from the stomach to the small intestine; see Kong, F. & Singh, R. P., 2008. Disintegration of Solid Foods in Human Stomach. *Journal of Food Science*, pp. 67-80) and then transferred to a simulated duodenal fluid (SDF) to digest for an additional 120 minutes. Samples at different stages of the digestion (e.g., 2, 5, 15, 30, 60 and 120 min) are analyzed by electrophoresis (e.g., chip electrophoresis or SDS-PAGE) to monitor the size and amount of intact protein as well as any large digestion fragments (e.g., larger than 4 kDa). The disappearance of protein over time indicates the rate at which the protein is digested in the assay. By monitoring the amount of intact protein observed over time, the half-life ($\tau_{1/2}$) of digestion is calculated for SGF and, if intact protein is detected after treatment with SGF, the $\tau_{1/2}$ of digestion is calculated for SIF. This assay can be used to assess comparative digestibility (i.e., against a benchmark protein such as whey) or to assess absolute digestibility. In some embodiments the digestibility of the nutritive protein is higher (i.e., the SGF $\tau_{1/2}$ and/or SIF $\tau_{1/2}$ is shorter) than whey protein. In some embodiments the nutritive protein has a SGF $\tau_{1/2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein has a SIF $\tau_{1/2}$ of 30 minutes or less, 20 minutes or less, 15 minutes or less, 10 minutes or less, 5 minutes or less, 4 minutes or less, 3 minutes or less, 2 minutes or less or 1 minute or less. In some embodiments the nutritive protein is not detectable in one or both of the SGF and SIF assays by 2 minutes, 5 minutes, 15 minutes, 30 minutes, 60 minutes, or 120 minutes. In some embodiments the nutritive protein is digested at a constant rate and/or at a controlled rate in one or both of SGF and SIF. In such embodiments the rate of digestion of the nutritive protein may not be optimized for the highest possible rate of digestion. In such embodiments the rate of absorption of the protein following ingestion by a mammal may be slower and the total time period over which absorption occurs following ingestion may be longer than for nutritive proteins of similar amino acid composition that are digested at a faster initial rate in one or both of SGF and SIF. In some embodiments the nutritive protein is completely or substantially completely digested in SGF. In some embodiments the nutritive protein is substantially not digested or not digested by SGF; in most such embodiments the protein is digested in SIF. Assessing protein digestibility can also provide insight into a protein's potential allergenicity, as proteins or large fragments of proteins that are resistant to digestive proteases can have a higher risk of causing an allergic reaction (Goodman, R. E. et al., 2008. Allergenicity assessment of genetically modified crops— what makes sense? *Nature Biotechnology*, pp. 73-81). To detect and identify peptides too small for chip electrophoresis analysis, liquid chromatography and mass spectrometry can be used. In SGF samples, peptides can be directly detected and identified by LC/MS. SIF protein digestions may require purification to remove bile acids before detection and identification by LC/MS.

In some embodiments digestibility of a nutritive protein is assessed by identification and quantification of digestive protease recognition sites in the protein amino acid sequence. In some embodiments the nutritive protein comprises at least one protease recognition site selected from a pepsin recognition site, a trypsin recognition site, and a chymotrypsin recognition site.

As used herein, a "pepsin recognition site" is any site in a polypeptide sequence that is experimentally shown to be cleaved by pepsin. In some embodiments it is a peptide bond after (i.e., downstream of) an amino acid residue selected from Phe, Trp, Tyr, Leu, Ala, Glu, and Gln, provided that the following residue is not an amino acid residue selected from Ala, Gly, and Val.

As used herein, a "trypsin recognition site" is any site in a polypeptide sequence that is experimentally shown to be cleaved by trypsin. In some embodiments it is a peptide bond after an amino acid residue selected from Lys or Arg, provided that the following residue is not a proline.

As used herein, a "chymotrypsin recognition site" is any site in a polypeptide sequence that is experimentally shown to be cleaved by chymotrypsin. In some embodiments it is a peptide bond after an amino acid residue selected from Phe, Tip, Tyr, and Leu.

Disulfide bonded cysteine residues in a protein tend to reduce the rate of digestion of the protein compared to what it would be in the absence of the disulfide bond. For example, it has been shown that the rate of digestion of the protein b-lactoglobulin is increased when its disulfide bridges are cleaved (I. M. Reddy, N. K. D. Kella, and J. E. Kinsella. "Structural and Conformational Basis of the Resistance of B-Lactoglobulin to Peptic and Chymotryptic Digestion". J. Agric. Food Chem. 1988, 36, 737-741). Accordingly, digestibility of a nutritive protein with fewer disulfide bonds tends to be higher than for a comparable nutritive protein with a greater number of disulfide bonds. In some embodiments the nutritive proteins disclosed herein are screened to identify the number of cysteine residues present in each and in particular to allow selection of a nutritive protein comprising a relatively low number of cysteine residues. For example, naturally occurring nutritive proteins or fragments may be identified that comprise a no Cys residues or that comprise a relatively low number of Cys residues, such as 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments one or more Cys residues in a naturally occurring nutritive protein or fragment thereof is removed by deletion and/or by substitution with another amino acid. In some embodiments 1 Cys residue is deleted or replaced, 1 or more Cys residues are deleted or replaced, 2 or more Cys residues are deleted or replaced, 3 or more Cys residues are deleted or replaced, 4 or more Cys residues are deleted or replaced, 5 or more Cys residues are deleted or replaced, 6 or more Cys residues are deleted or replaced, 7 or more Cys residues are deleted or replaced, 8 or more Cys residues are deleted or replaced, 9 or more Cys residues are deleted or replaced, or 10 or more Cys residues are deleted or replaced. In some embodiments the nutritive protein of this disclosure comprises a ratio of Cys residues to total amino acid residues equal to or lower than 5%, 4%, 3%, 2%, or 1%. In some embodiments the nutritive protein comprises 10 or fewer Cys residues, 9 or fewer Cys residues, 8 or fewer Cys residues, 7 or fewer Cys residues, 6 or fewer Cys residues, 5 or fewer Cys residues, 4 or fewer Cys residues, 3 or fewer Cys residues, 2 or fewer Cys residues, 1 Cys residue, or no Cys residues. In some embodiments, the nutritive protein comprises 1 or fewer Cys residues. In some embodiments, the nutritive protein comprises no Cys residues.

Alternatively or in addition, disulfide bonds that are or may be present in a nutritive protein may be removed. Disulfides can be removed using chemical methods by reducing the disulfide to two thiol groups with reducing agents such as beta-mercaptoethanol, dithiothreitol (DTT), or tris(2-carboxyethyl)phosphine (TCEP). The thiols can then be covalently modified or "capped" with reagents such as iodoacetamide, N-ethylmaleimide, or sodium sulfite (see, e.g., Crankshaw, M. W. and Grant, G. A. 2001. Modification of Cysteine. Current Protocols in Protein Science. 15.1.1-15.1.18).

Eukaryotic proteins are often glycosylated, and the carbohydrate chains that are attached to proteins serve various functions. N-linked and O-linked glycosylation are the two most common forms of glycosylation occurring in proteins. N-linked glycosylation is the attachment of a sugar molecule to a nitrogen atom in an amino acid residue in a protein. N-linked glycosylation occurs at Asparagine and Arginine residues. O-linked glycosylation is the attachment of a sugar molecule to an oxygen atom in an amino acid residue in a protein. O-linked glycosylation occurs at Threonine and Serine residues.

Glycosylated proteins are often more soluble than their un-glycosylated forms. In terms of protein drugs, proper glycosylation usually confers high activity, proper antigen binding, better stability in the blood, etc. However, glycosylation necessarily means that a protein "carries with it" sugar moieties. Such sugar moieties may reduce the usefulness of the nutritive proteins of this disclosure including recombinant nutritive proteins. For example, as demonstrated in the examples, a comparison of digestion of glycosylated and non-glycosylated forms of the same proteins shows that the non-glycosylated forms are digested more quickly than the glycosylated forms. For these reasons, in some embodiments the nutritive proteins according to the disclosure comprise low or no glycosylation. For example, in some embodiments the nutritive proteins comprise a ratio of non-glycosylated to total amino acid residues of at least 80%, at least 85%, at least 90%, at least 95%, at least 96%, at least 97%, at least 98%, or at least 99%. In some embodiments the nutritive proteins to not comprise any glycosylation.

In some embodiments, the nutritive protein according to the disclosure is de-glycosylated after it is produced or after it is isolated. Nutritive proteins of low or no glycosylation may be made by any method known in the art. For example, enzymatic and/or chemical methods may be used (Biochem. J. (2003) 376, p 339-350.). Enzymes are produced commercially at research scales for the removal of N-linked and O-linked oligosaccharides. Chemical methods include use of trifluoromethanesulfonic acid to selectively break N-linked and O-linked peptide-saccharide bonds. This method often results in a more complete deglycosylation than does the use of enzymatic methods.

In other embodiments, the nutritive protein according to the disclosure is produced with low or no glycosylation by a host organism. Most bacteria and other prokaryotes have very limited capabilities to glycosylate proteins, especially heterologous proteins. Accordingly, in some embodiments of this disclosure a nutritive protein is made recombinantly in a microorganism such that the level of glycosylation of the recombinant protein is low or no glycosylation. In some embodiments the level of glycosylation of the recombinant nutritive protein is lower than the level of glycosylation of the protein as it occurs in the organism from which it is derived.

In some embodiments a nutritive protein or polypeptide according to the disclosure comprises a ratio of amino acids selected from Asn, Arg, Ser, and Thr to total amino acids of 20% or less, 19% or less, 18% or less, 17% or less, 16% or less, 15% or less, 14% or less, 13% or less, 12% or less, 11% or less, 10% or less, 9% or less, 8% or less, 7% or less, 6% or less, 5% or less, 4% or less, 3% or less, 2% or less, 1% or less. In some embodiments, a nutritive protein or polypeptide according to the disclosure comprises no amino acids selected from Asn, Arg, Ser, and Thr. In some embodiments a nutritive protein or polypeptide according to the disclosure comprises fewer than 20, fewer than 19, fewer than 18, fewer than 17, fewer than 16, fewer than 15, fewer than 14, fewer than 13, fewer than 12, fewer than 11, fewer than 10, fewer than 9, fewer than 8, fewer than 7, fewer than 6, fewer than 5, fewer than 4, fewer than 3, fewer than 2, fewer than 1, or no amino acids selected from Asn, Arg, Ser, and Thr.

As used herein, a "stable" protein is one that resists changes (e.g., unfolding, oxidation, aggregation, hydrolysis, etc.) that alter the biophysical (e.g., solubility), biological (e.g., digestibility), or compositional (e.g. proportion of Leucine amino acids) traits of the protein of interest.

Protein stability can be measured using various assays known in the art and nutritive proteins disclosed herein and having stability above a threshold can be selected. In some embodiments a protein is selected that displays thermal stability that is comparable to or better than that of whey protein. Thermal stability is a property that can help predict the shelf life of a nutritive protein. In some embodiments of the assay stability of nutritive protein samples is determined by monitoring aggregation formation using size exclusion chromatography (SEC) after exposure to extreme temperatures. Aqueous samples of the protein to be tested are placed in a heating block at 90° C. and samples are taken after 0, 1, 5, 10, 30 and 60 min for SEC analysis. Protein is detected by monitoring absorbance at 214 nm, and aggregates are characterized as peaks eluting faster than the protein of interest. No overall change in peak area indicates no precipitation of protein during the heat treatment. Whey protein has been shown to rapidly form ~80% aggregates when exposed to 90° C. in such an assay.

In some embodiments the thermal stability of a nutritive protein is determined by heating a sample slowly from 25° C. to 95° C. in presence of a hydrophobic dye (e.g., ProteoStat® Thermal shift stability assay kit, Enzo Life Sciences) that binds to aggregated proteins that are formed as the protein denatures with increasing temperature (Niesen, F. H., Berglund, H. & Vadadi, M., 2007. The use of differential scanning fluorimetry to detect ligand interactions that promote protein stability. *Nature Protocols*, Volume 2, pp. 2212-2221). Upon binding, the dye's fluorescence increases significantly, which is recorded by an rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. *Journal of the American Chemical Society*, pp. 3794-3795). After the thermal shift is complete, samples are examined for insoluble precipitates and further analyzed by analytical size exclusion chromatography (SEC).

In some embodiments a nutritive protein of this disclosure shows resistance to aggregation, exhibiting, for example, less than 80% aggregation, 10% aggregation, or no detectable aggregation at elevated temperatures (e.g, 50° C., 60° C., 70° C., 80° C., 85° C., 90° C., or 95° C.).

One benefit of stable nutritive proteins as disclosed herein is that they may be able to be stored for an extended period of time before use, in some instances without the need for refrigeration or cooling. In some embodiments, nutritive proteins are processed into a dry form (e.g., by lyophilization). In some embodiments, nutritive proteins are stable upon lyophilization. In some embodiments, such lyophilized nutritive proteins maintain their stability upon reconstitution (e.g., liquid formulation).

For most embodiments it is preferred that the nutritive protein not exhibit inappropriately high allergenicity. Accordingly, in some embodiments the potential allergenicity of the nutritive protein is assessed. This can be done by any suitable method known in the art. In some embodiments an allergenicity score is calculated. The allergenicity score is a primary sequence based metric based on WHO recommendations (http://www.fao.org/ag/agn/food/pdf/allergygm.pdf) for assessing how similar a protein is to any known allergen, the primary hypothesis being that high percent identity between a target and a known allergen is likely indicative of cross reactivity. For a given protein, the likelihood of eliciting an allergic response can be assessed via one or both of a complimentary pair of sequence homology based tests. The first test determines the protein's percent identity across the entire sequence via a global-global sequence alignment to a database of known allergens using the FASTA algorithm with the BLOSUM50 substitution matrix, a gap open penalty of 10, and a gap extension penalty of 2. It has been suggested that proteins with less than 50% global homology are unlikely to be allergenic (Goodman R. E. et al. Allergenicity assessment of genetically modified crops—what makes sense? Nat. Biotech. 26, 73-81 (2008); Aalberse R. C. Structural biology of allergens. J. Allergy Clin. Immunol. 106, 228-238 (2000)).

In some embodiments of a nutritive protein, the nutritive protein has less than 50% global homology to any known allergen in the database used for the analysis. In some embodiments a cutoff of less than 40% homology is used. In some embodiments a cutoff of less than 30% homology is used. In some embodiments a cutoff of less than 20% homology is used. In some embodiments a cutoff of less than 10% homology is used. In some embodiments a cutoff of from 40% to 50% is used. In some embodiments a cutoff of from 30% to 50% is used. In some embodiments a cutoff of from 20% to 50% is used. In some embodiments a cutoff of from 10% to 50% is used. In some embodiments a cutoff of from 5% to 50% is used. In some embodiments a cutoff of from 0% to 50% is used. In some embodiments a cutoff of greater than 50% global homology to any known allergen in the database used for the analysis is used. In some embodiments a cutoff of from 50% to 60% is used. In some embodiments a cutoff of from 50% to 70% is used. In some embodiments a cutoff of from 50% to 80% is used. In some embodiments a cutoff of from 50% to 90% is used. In some embodiments a cutoff of from 55% to 60% is used. In some embodiments a cutoff of from 65% to 70% is used. In some embodiments a cutoff of from 70% to 75% is used. In some embodiments a cutoff of from 75% to 80% is used.

The second test assesses the local allergenicity along the protein sequence by determining the local allergenicity of all possible contiguous 80 amino acid fragments via a global-local sequence alignment of each fragment to a database of known allergens using the FASTA algorithm with the BLOSUM50 substitution matrix, a gap open penalty of 10, and a gap extension penalty of 2. The highest percent identity of any 80 amino acid window with any allergen is taken as the final score for the protein of interest. The WHO guidelines suggest using a 35% identity cutoff with this fragment test. In some embodiments of a nutritive protein, all possible fragments of the nutritive protein have less than 35% local homology to any known allergen in the database used for the analysis using this test. In some embodiments a cutoff of less than 30% homology is used. In some embodiments a cutoff of from 30% to 35% homology is used. In some embodiments a cutoff of from 25% to 30% homology is used. In some embodiments a cutoff of from 20% to 25% homology is used. In some embodiments a cutoff of from 15% to 20% homology is used. In some embodiments a cutoff of from 10% to 15% homology is used. In some embodiments a cutoff of from 5% to 10% homology is used. In some embodiments a cutoff of from 0% to 5% homology is used. In some embodiments a cutoff of greater than 35% homology is used. In some embodiments a cutoff of from 35% to 40% homology is used. In some embodiments a cutoff of from 40% to 45% homology is used. In some embodiments a cutoff of from 45% to 50% homology is used. In some embodiments a cutoff of from 50% to 55% homology is used. In some embodiments a cutoff of from 55% to 60% homology is used. In some embodiments a cutoff of from 65% to 70% homology is used. In some embodiments a cutoff of from 70% to 75% homology is used. In some embodiments a cutoff of from 75% to 80% homology is used.

Skilled artisans are able to identify and use a suitable database of known allergens for this purpose. In some embodiments the database is custom made by selecting proteins from more than one database source. In some embodiments the custom database comprises pooled allergen lists collected by the Food Allergy Research and Resource Program (http://www.allergenonline.org/), UNIPROT annotations (http://www.uniprot.org/docs/allergen), and the Structural Database of Allergenic Proteins (SDAP, http://fermi.utmb.edu/SDAP/sdap_lnk.html). This database includes all currently recognized allergens by the International Union of Immunological Societies (IUIS, http://www.allergen.org/) as well as a large number of additional allergens not yet officially named. In some embodiments the database comprises a subset of known allergen proteins available in known databases; that is, the database is a custom selected subset of known allergen proteins. In some embodiments the database of known allergens comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known allergens comprises from 100 to 500 proteins, from 200 to 1,000 proteins, from 500 to 1,000 proteins, from 500 to 1,000 proteins, or from 1,000 to 2,000 proteins.

In some embodiments all (or a selected subset) of contiguous amino acid windows of different lengths (e.g., 70, 60, 50, 40, 30, 20, 10, 8 or 6 amino acid windows) of a nutritive protein are tested against the allergen database and peptide sequences that have 100% identity, 95% or higher identity, 90% or higher identity, 85% or higher identity, 80% or higher identity, 75% or higher identity, 70% or higher identity, 65% or higher identity, 60% or higher identity, 55% or higher identity, or 50% or higher identity matches are identified for further examination of potential allergenicity.

Another method of predicting the allergenicity of a protein is to assess the homology of the protein to a protein of human origin. The human immune system is exposed to a multitude of possible allergenic proteins on a regular basis and has the intrinsic ability to differentiate between the host body's proteins and exogenous proteins. The exact nature of this ability is not always clear, and there are many diseases that arise as a result of the failure of the body to differentiate self from non-self (e.g. arthritis). Nonetheless, the fundamental hypothesis is that proteins that share a degree of sequence homology to human proteins are less likely to elicit an immune response. In particular, it has been shown that for some protein families with known allergenic members (tropomyosins, parvalbumins, caseins), those proteins that bear more sequence homology to their human counterparts relative to known allergenic proteins, are not thought to be allergenic (Jenkins J A. et al. Evolutionary distance from human homologs reflects allergenicity of animal food proteins. J. Allergy Clin Immunol. 120 (2007): 1399-1405). For a given protein, a human homology score is measured by determining the maximum percent identity of the protein to a database of human proteins (e.g., the UNIPROT database) from a global-local alignment using the FASTA algorithm with the BLOSUM50 substitution matrix, a gap open penalty of 10, and a gap extension penalty of 2. According to Jenkins et al. (Jenkins J. A. et al. Evolutionary distance from human homologs reflects allergenicity of animal food proteins. J. Allergy Clin Immunol. 120 (2007): 1399-1405) proteins with a sequence identity to a human protein above about 62% are less likely to be allergenic. Skilled artisans are able to identify and use a suitable database of known human proteins for this purpose, for example, by searching the UNIPROT database (http://www.uniprot.org). In some embodiments the database is custom made by selecting proteins from more than one database source. Of course the database may but need not be comprehensive. In some embodiments the database comprises a subset of human proteins; that is, the database is a custom selected subset of human proteins. In some embodiments the database of human proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins. In some embodiments the database comprises at least 90%, at least 95%, or at least 99% of all known human proteins.

In some embodiments of a nutritive protein, the nutritive protein is at least 20% homologous to a human protein. In some embodiments a cutoff of at least 30% homology is used. In some embodiments a cutoff of at least 40% homology is used. In some embodiments a cutoff of at least 50% homology is used. In some embodiments a cutoff of at least 60% homology is used. In some embodiments a cutoff of at least 70% homology is used. In some embodiments a cutoff of at least 80% homology is used. In some embodiments a cutoff of at least 62% homology is used. In some embodiments a cutoff of from at least 20% homology to at least 30% homology is used. In some embodiments a cutoff of from at least 30% homology to at least 40% homology is used. In some embodiments a cutoff of from at least 50% homology to at least 60% homology is used. In some embodiments a cutoff of from at least 60% homology to at least 70% homology is used. In some embodiments a cutoff of from at least 70% homology to at least 80% homology is used.

For most embodiments it is preferred that the nutritive protein not exhibit inappropriately high toxicity. Accordingly, in some embodiments the potential toxicity of the nutritive protein is assessed. This can be done by any suitable method known in the art. In some embodiments a toxicity score is calculated by determining the protein's percent identity to databases of known toxic proteins (e.g., toxic proteins identified from the UNIPROT database). A global-global alignment of the protein of interest against the database of known toxins is performed using the FASTA algorithm with the BLOSUM50 substitution matrix, a gap open penalty of 10, and a gap extension penalty of 2. In some embodiments of a nutritive protein, the nutritive protein is less than 35% homologous to a known toxin. In some embodiments a cutoff of less than 35% homology is used. In some embodiments a cutoff of from 30% to 35% homology is used. In some embodiments a cutoff of from 25% to 35% homology is used. In some embodiments a cutoff of from 20% to 35% homology is used. In some embodiments a cutoff of from 15% to 35% homology is used. In some embodiments a cutoff of from 10% to 35% homology is used. In some embodiments a cutoff of from 5% to 35% homology is used. In some embodiments a cutoff of from 0% to 35% homology is used. In some embodiments a cutoff of greater than 35% homology is used. In some embodiments a cutoff of from 35% to 40% homology is used. In some embodiments a cutoff of from 35% to 45% homology is used. In some embodiments a cutoff of from 35% to 50% homology is used. In some embodiments a cutoff of from 35% to 55% homology is used. In some embodiments a cutoff of from 35% to 60% homology is used. In some embodiments a cutoff of from 35% to 70% homology is used. In some embodiments a cutoff of from 35% to 75% homology is used. In some embodiments a cutoff of from 35% to 80% homology is used. Skilled artisans are able to identify and use a suitable database of known toxins for this purpose, for example, by searching the UNIPROT database (http://www.uniprot.org). In some embodiments the database is custom made by selecting proteins identified as toxins from more than one database source. In some embodiments the database comprises a subset of known toxic proteins; that is, the database is a custom selected subset of known toxic proteins. In some embodiments the database of toxic proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 2,000 proteins, at least 3,000 proteins, at least 4,000 proteins, at least 5,000 proteins, at least 6,000 proteins, at least 7,000 proteins, at least 8,000 proteins, at least 9,000 proteins, or at least 10,000 proteins. In some embodiments the database comprises from 100 to 500 proteins, from 200 to 1,000 proteins, from 500 to 1,000 proteins, from 500 to 1,000 proteins, from 1,000 to 2,000 proteins, from 1,000 to 5,000 proteins, or from 5,000 to 10,000 proteins.

For some embodiments it is preferred that the nutritive protein not exhibit anti-nutritional activity ("anti-nutricity"), i.e., proteins that have the potential to prevent the absorption of nutrients from food. Examples of anti-nutritive factors include protease inhibitors, which inhibit the actions of trypsin, pepsin and other proteases in the gut, preventing the digestion and subsequent absorption of protein. Accordingly, in some embodiments the potential anti-nutricity of the nutritive protein is assessed. This can be done by any suitable method known in the art. In some embodiments an anti-nutricity score is calculated by determining the protein's percent identity to databases of known protease inhibitors (e.g., protease inhibitors identified from the UNIPROT database). A global-global alignment of the protein of interest against the database of known protease inhibitors is performed using the FASTA algorithm with the BLOSUM50 substitution matrix, a gap open penalty of 10, and a gap extension penalty of 2, to identify whether the nutritive protein is homologous to a known anti-nutritive protein. In some embodiments of a nutritive protein, the nutritive protein has less than 35% global homology to any known anti-nutritive protein (e.g., any known protease inhibitor) in the database used for the analysis. In some embodiments a cutoff of less than 35% identify is used. In some embodiments a cutoff of from 30% to 35% is used. In some embodiments a cutoff of from 25% to 35% is used. In some embodiments a cutoff of from 20% to 35% is used. In some embodiments a cutoff of from 15% to 35% is used. In some embodiments a cutoff of from 10% to 35% is used. In some embodiments a cutoff of from 5% to 35% is used. In some embodiments a cutoff of from 0% to 35% is used. In some embodiments a cutoff of greater than 35% identify is used. In some embodiments a cutoff of from 35% to 40% is used. In some embodiments a cutoff of from 35% to 45% is used. In some embodiments a cutoff of from 35% to 50% is used. In some embodiments a cutoff of from 35% to 55% is used. In some embodiments a cutoff of from 35% to 60% is used. In some embodiments a cutoff of from 35% to 70% is used. In some embodiments a cutoff of from 35% to 75% is used. In some embodiments a cutoff of from 35% to 80% is used. Skilled artisans are able to identify and use a suitable database of known protease inhibitors for this purpose, for example, by searching the UNIPROT database (http://www.uniprot.org). In some embodiments the database is custom made by selecting proteins identified protease-inhibitors as from more than one database source. In some embodiments the database comprises a subset of known protease inhibitors available in databases; that is, the database is a custom selected subset of known protease inhibitor proteins. In some embodiments the database of known protease inhibitor proteins comprises at least 10 proteins, at least 20 proteins, at least 30 proteins, at least 40 proteins, at least 50 proteins, at least 100, proteins, at least 200 proteins, at least 300 proteins, at least 400 proteins, at least 500 proteins, at least 600 proteins, at least 700 proteins, at least 800 proteins, at least 900 proteins, at least 1,000 proteins, at least 1,100 proteins, at least 1,200 proteins, at least 1,300 proteins, at least 1,400 proteins, at least 1,500 proteins, at least 1,600 proteins, at least 1,700 proteins, at least 1,800 proteins, at least 1,900 proteins, or at least 2,000 proteins. In some embodiments the database of known protease inhibitor proteins comprises from 100 to 500 proteins, from 200 to 1,000 proteins, from 500 to 1,000 proteins, from 500 to 1,000 proteins, or from 1,000 to 2,000 proteins, or from 2,000 to 3,000 proteins.

In other embodiments a nutritive protein that does exhibit some degree of protease inhibitor activity is used. For example, in some embodiments such a protein may be useful because it delays protease digestion when the nutritive protein is consumed such that the nutritive protein traverses a greater distance within the GI tract before it is digested, thus delaying absorption. For example, in some embodiments the nutritive protein inhibits gastric digestion but not intestinal digestion.

Delaney B. et al. (Evaluation of protein safety in the context of agricultural biotechnology. Food. Chem. Toxicol. 46 (2008: S71-S97)) suggests that one should avoid both known toxic and anti-nutritive proteins when assessing the safety of a possible food protein. In some embodiments of a nutritive protein, the nutritive protein has a favorably low level of global homology to a database of known toxic proteins and/or a favorably low level of global homology to a database of known anti-nutricity proteins (e.g., protease inhibitors), as defined herein.

Certain free amino acids and mixtures of free amino acids are known to have a bitter or otherwise unpleasant taste. In addition, hydrolysates of common proteins (e.g., whey and soy) often have a bitter or unpleasant taste. In some embodiments, nutritive proteins disclosed and described herein do not have a bitter or otherwise unpleasant taste. In some embodiments, nutritive proteins disclosed and described herein have a more acceptable taste as compared to at least one of free amino acids, mixtures of free amino acids, and/or protein hydrolysates. In some embodiments, nutritive proteins disclosed and described herein have a taste that is equal to or exceeds at least one of whey protein.

Proteins are known to have tastes covering the five established taste modalities: sweet, sour, bitter, salty and umami. The taste of a particular protein (or its lack thereof) can be attributed to several factors, including the primary structure, the presence of charged side chains, and the electronic and conformational features of the protein. In some embodiments, nutritive proteins disclosed and described herein are designed to have a desired taste (e.g., sweet, salty, umami) and/or not to have an undesired taste (e.g., bitter, sour). In this context "design" includes, for example, selecting naturally occurring proteins embodying features that achieve the desired taste property, as well as creating muteins of naturally-occurring proteins that have desired taste properties. For example, nutritive proteins can be designed to interact with specific taste receptors, such as sweet receptors (T1R2-T1R3 heterodimer) or umami receptors (T1R1-T1R3 heterodimer, mGluR4, and/or mGluR1). Further, nutritive proteins may be designed not to interact, or to have diminished interaction, with other taste receptors, such as bitter receptors (T2R receptors).

Nutritive proteins disclosed and described herein can also elicit different physical sensations in the mouth when ingested, sometimes referred to as "mouth feel". The mouth feel of the nutritive proteins may be due to one or more factors including primary structure, the presence of charged side chains, and the electronic and conformational features of the protein. In some embodiments, nutritive proteins elicit a buttery or fat-like mouth feel when ingested.

In some embodiments the nutritive protein comprises from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids. In some embodiments the nutritive protein consists of from 20 to 5,000 amino acids, from 20-2,000 amino acids, from 20-1,000 amino acids, from 20-500 amino acids, from 20-250 amino acids, from 20-200 amino acids, from 20-150 amino acids, from 20-100 amino acids, from 20-40 amino acids, from 30-50 amino acids, from 40-60 amino acids, from 50-70 amino acids, from 60-80 amino acids, from 70-90 amino acids, from 80-100 amino acids, at least 25 amino acids, at least 30 amino acids, at least 35 amino acids, at least 40 amino acids, at least 2455 amino acids, at least 50 amino acids, at least 55 amino acids, at least 60 amino acids, at least 65 amino acids, at least 70 amino acids, at least 75 amino acids, at least 80 amino acids, at least 85 amino acids, at least 90 amino acids, at least 95 amino acids, at least 100 amino acids, at least 105 amino acids, at least 110 amino acids, at least 115 amino acids, at least 120 amino acids, at least 125 amino acids, at least 130 amino acids, at least 135 amino acids, at least 140 amino acids, at least 145 amino acids, at least 150 amino acids, at least 155 amino acids, at least 160 amino acids, at least 165 amino acids, at least 170 amino acids, at least 175 amino acids, at least 180 amino acids, at least 185 amino acids, at least 190 amino acids, at least 195 amino acids, at least 200 amino acids, at least 205 amino acids, at least 210 amino acids, at least 215 amino acids, at least 220 amino acids, at least 225 amino acids, at least 230 amino acids, at least 235 amino acids, at least 240 amino acids, at least 245 amino acids, or at least 250 amino acids.

B. Nucleic Acids

Also provided herein are nucleic acids encoding nutritive polypeptides or proteins. In some embodiments the nucleic acid is isolated. In some embodiments the nucleic acid is purified.

In some embodiments of the nucleic acid, the nucleic acid comprises a nucleic acid sequence that encodes a first polypeptide sequence disclosed in Section A above. In some embodiments of the nucleic acid, the nucleic acid consists of a nucleic acid sequence that encodes a first polypeptide sequence disclosed in Section A above. In some embodiments of the nucleic acid, the nucleic acid comprises a nucleic acid sequence that encodes a nutritive protein disclosed in Section A above. In some embodiments of the nucleic acid, the nucleic acid consists of a nucleic acid sequence that encodes a nutritive protein disclosed in Section A above. In some embodiments of the nucleic acid the nucleic acid sequence that encodes the first polypeptide sequence is operatively linked to at least one expression control sequence. For example, in some embodiments of the nucleic acid the nucleic acid sequence that encodes the first polypeptide sequence is operatively linked to a promoter such as a promoter described in Section D below.

Accordingly, in some embodiments the nucleic acid molecule of this disclosure encodes a polypeptide or protein that itself is a nutritive polypeptide or protein. Such a nucleic acid molecule may be referred to as a "nutritive nucleic acid". In some embodiments the nutritive nucleic acid encodes a polypeptide or protein that itself comprises at least one of: a) a ratio of branch chain amino acid residues to total amino acid residues of at least 24%; b) a ratio of Leu residues to total amino acid residues of at least 11%; and c) a ratio of essential amino acid residues to total amino acid residues of at least 49%. In some embodiments the nutritive nucleic acid comprises at least 10 nucleotides, at least 20 nucleotides, at least 30 nucleotides, at least 40 nucleotides, at least 50 nucleotides, at least 60 nucleotides, at least 70 nucleotides, at least 80 nucleotides, at least 90 nucleotides, at least 100 nucleotides, at least 200 nucleotides, at least 300 nucleotides, at least 400 nucleotides, at least 500 nucleotides, at least 600 nucleotides, at least 700 nucleotides, at least 800 nucleotides, at least 900 nucleotides, at least 1,000 nucleotides. In some embodiments the nutritive nucleic acid comprises from 10 to 100 nucleotides, from 20 to 100 nucleotides, from 10 to 50 nucleotides, or from 20 to 40 nucleotides. In some embodiments the nutritive nucleic acid comprises all or part of an open reading frame that encodes a naturally occurring nutritive polypeptide or protein. In some embodiments the nutritive nucleic acid consists of an open reading frame that encodes a fragment of a naturally occurring nutritive protein, wherein the open reading frame does not encode the complete naturally occurring nutritive protein.

In some embodiments the nutritive nucleic acid is a cDNA.

In some embodiments nucleic acid molecules are provided that comprise a sequence that is at least 50%, 60%, 70%, 80%, 85%, 90%, 95%, 96%, 97%, 98%, 99%, or 99.9% identical to a naturally occurring nutritive nucleic acid. In some embodiments nucleic acids are provided that hybridize under stringent hybridization conditions with at least one reference nutritive nucleic acid.

The nutritive nucleic acids and fragments thereof provided in this disclosure display utility in a variety of systems and methods. For example, the fragments may be used as probes in various hybridization techniques. Depending on the method, the target nucleic acid sequences may be either DNA or RNA. The target nucleic acid sequences may be fractionated (e.g., by gel electrophoresis) prior to the hybridization, or the hybridization may be performed on samples in situ. One of skill in the art will appreciate that nucleic acid probes of known sequence find utility in determining chromosomal structure (e.g., by Southern blotting) and in measuring gene expression (e.g., by Northern blotting). In such experiments, the sequence fragments are preferably detectably labeled, so that their specific hydridization to target sequences can be detected and optionally quantified. One of skill in the art will appreciate that the nucleic acid fragments of this disclosure may be used in a wide variety of blotting techniques not specifically described herein.

It should also be appreciated that the nucleic acid sequence fragments disclosed herein also find utility as probes when immobilized on microarrays. Methods for creating microarrays by deposition and fixation of nucleic acids onto support substrates are well known in the art. Reviewed in DNA Microarrays: A Practical Approach (Practical Approach Series), Schena (ed.), Oxford University Press (1999) (ISBN: 0199637768); Nature Genet. 21(1)(suppl):1-60 (1999); Microarray Biochip: Tools and Technology, Schena (ed.), Eaton Publishing Company/BioTechniques Books Division (2000) (ISBN: 1881299376), the disclosures of which are incorporated herein by reference in their entireties. Analysis of, for example, gene expression using microarrays comprising nucleic acid sequence fragments, such as the nucleic acid sequence fragments disclosed herein, is a well-established utility for sequence fragments in the field of cell and molecular biology. Other uses for sequence fragments immobilized on microarrays are described in Gerhold et al., Trends Biochem. Sci. 24:168-173 (1999) and Zweiger, Trends Biotechnol. 17:429-436 (1999); DNA Microarrays: A Practical Approach (Practical Approach Series), Schena (ed.), Oxford University Press (1999) (ISBN: 0199637768); Nature Genet. 21(1)(suppl):1-60 (1999); Microarray Biochip: Tools and Technology, Schena (ed.), Eaton Publishing Company/Bio-Techniques Books Division (2000) (ISBN: 1881299376).

C. Vectors

Also provided are vectors, including expression vectors, which comprise at least one of the nucleic acid molecules disclosed herein, as described further herein. In some embodiments, the vectors comprise at least one isolated nucleic acid molecule encoding a nutritive protein as disclosed herein. In alternative embodiments, the vectors comprise such a nucleic acid molecule operably linked to one or more expression control sequence. The vectors can thus be used to express at least one recombinant protein in a recombinant microbial host cell.

Suitable vectors for expression of nucleic acids in microorganisms are well known to those of skill in the art. Suitable vectors for use in cyanobacteria are described, for example, in Heidorn et al., "Synthetic Biology in Cyanobacteria: Engineering and Analyzing Novel Functions," Methods in Enzymology, Vol. 497, Ch. 24 (2011). Exemplary replicative vectors that can be used for engineering cyanobacteria as disclosed herein include pPMQAK1, pSL1211, pFC1, pSB2A, pSCR119/202, pSUN119/202, pRL2697, pRL25C, pRL1050, pSG111M, and pPBH201.

Other vectors such as pJB161 which are capable of receiving nucleic acid sequences disclosed herein may also be used. Vectors such as pJB161 comprise sequences which are homologous with sequences present in plasmids endogenous to certain photosynthetic microorganisms (e.g., plasmids pAQ1, pAQ3, and pAQ4 of certain *Synechococcus* species). Examples of such vectors and how to use them is known in the art and provided, for example, in Xu et al., "Expression of Genes in Cyanobacteria: Adaptation of Endogenous Plasmids as Platforms for High-Level Gene Expression in *Synechococcus* sp. PCC 7002," Chapter 21 in Robert Carpentier (ed.), "Photosynthesis Research Protocols," Methods in Molecular Biology, Vol. 684, 2011, which is hereby incorporated herein by reference. Recombination between pJB161 and the endogenous plasmids in vivo yield engineered microbes expressing the genes of interest from their endogenous plasmids. Alternatively, vectors can be engineered to recombine with the host cell chromosome, or the vector can be engineered to replicate and express genes of interest independent of the host cell chromosome or any of the host cell's endogenous plasmids.

A further example of a vector suitable for recombinant protein production is the pET system (Novagen®). This system has been extensively characterized for use in *E. coli* and other microorganisms. In this system, target genes are cloned in pET plasmids under control of strong bacteriophage T7 transcription and (optionally) translation signals; expression is induced by providing a source of T7 RNA polymerase in the host cell. T7 RNA polymerase is so selective and active that, when fully induced, almost all of the microorganism's resources are converted to target gene expression; the desired product can comprise more than 50% of the total cell protein a few hours after induction. It is also possible to attenuate the expression level simply by lowering the concentration of inducer. Decreasing the expression level may enhance the soluble yield of some target proteins. In some embodiments this system also allows for maintenance of target genes in a transcriptionally silent un-induced state.

In some embodiments of using this system, target genes are cloned using hosts that do not contain the T7 RNA polymerase gene, thus alleviating potential problems related to plasmid instability due to the production of proteins potentially toxic to the host cell. Once established in a non-expression host, target protein expression may be initiated either by infecting the host with λCE6, a phage that carries the T7 RNA polymerase gene under the control of the λ pL and pI promoters, or by transferring the plasmid into an expression host containing a chromosomal copy of the T7 RNA polymerase gene under lacUV5 control. In the second case, expression is induced by the addition of IPTG or lactose to the bacterial culture or using an autoinduction medium. Other plasmids systems that are controlled by the lac operator, but do not require the T7 RNA polymerase gene and rely upon *E. coli*'s native RNA polymerase include the pTrc plasmid suite (Invitrogen) or pQE plamid suite (QIAGEN).

In other embodiments it is possible to clone directly into expression hosts. Two types of T7 promoters and several hosts that differ in their stringency of suppressing basal expression levels are available, providing great flexibility and the ability to optimize the expression of a wide variety of target genes.

Suitable vectors for expression of nucleic acids in mammalian cells typically comprise control functions provided by viral regulatory elements. For example, commonly used promoters are derived from polyoma virus, Adenovirus 2, cytomegalovirus, or Simian Virus 40.

D. Promoters

Promoters useful for expressing the recombinant genes described herein include both constitutive and inducible/repressible promoters. Examples of inducible/repressible promoters include nickel-inducible promoters (e.g., PnrsA, PnrsB; see, e.g., Lopez-Mauy et al., Cell (2002) v. 43: 247-256) and urea repressible promoters such as PnirA (described in, e.g., Qi et al., Applied and Environmental Microbiology (2005) v. 71: 5678-5684). Additional examples of inducible/repressible promoters include PnirA (promoter that drives expression of the nirA gene, induced by nitrate and repressed by urea) and Psuf (promoter that drives expression of the sufB gene, induced by iron stress). Examples of constitutive promoters include Pcpc (promoter that drives expression of the cpc operon), Prbc (promoter that drives expression of rubisco), PpsbAII (promoter that drives expression of PpsbAII), Pcro (lambda phage promoter that drives expression of cro). In other embodiments, a PaphII and/or a lacIq-Ptrc promoter can used to control expression. Where multiple recombinant genes are expressed in an engineered microorganism, the different genes can be controlled by different promoters or by identical promoters in separate operons, or the expression of two or more genes may be controlled by a single promoter as part of an operon.

Further non-limiting examples of inducible promoters may include, but are not limited to, those induced by expression of an exogenous protein (e.g., T7 RNA polymerase, SP6 RNA polymerase), by the presence of a small molecule (e.g., IPTG, galactose, tetracycline, steroid hormone, abscisic acid), by absence of small molecules (e.g., $CO_2$, iron, nitrogen), by metals or metal ions (e.g., copper, zinc, cadmium, nickel), and by environmental factors (e.g., heat, cold, stress, light, darkness), and by growth phase. In some embodiments, the inducible promoter is tightly regulated such that in the absence of induction, substantially no transcription is initiated through the promoter. In some embodiments, induction of the promoter does not substantially alter transcription through other promoters. Also, generally speaking, the compound or condition that induces an inducible promoter is not be naturally present in the organism or environment where expression is sought.

In some embodiments, the inducible promoter is induced by limitation of $CO_2$ supply to a cyanobacteria culture. By way of non-limiting example, the inducible promoter may be the promoter sequence of Synechocystis PCC 6803 that are up-regulated under the $CO_2$-limitation conditions, such as the cmp genes, ntp genes, ndh genes, sbt genes, chp genes, and rbc genes, or a variant or fragment thereof.

In some embodiments, the inducible promoter is induced by iron starvation or by entering the stationary growth phase. In some embodiments, the inducible promoter may be variant sequences of the promoter sequence of cyanobacterial genes that are up-regulated under Fe-starvation conditions such as isiA, or when the culture enters the stationary growth phase, such as isiA, phrA, sigC, sigB, and sigH genes, or a variant or fragment thereof.

In some embodiments, the inducible promoter is induced by a metal or metal ion. By way of non-limiting example, the inducible promoter may be induced by copper, zinc, cadmium, mercury, nickel, gold, silver, cobalt, and bismuth or ions thereof. In some embodiments, the inducible promoter is induced by nickel or a nickel ion. In some embodiments, the inducible promoter is induced by a nickel ion, such as $Ni^{2+}$. In another exemplary embodiment, the inducible promoter is the nickel inducible promoter from Synechocystis PCC 6803. In another embodiment, the inducible promoter may be induced by copper or a copper ion. In yet another embodiment, the inducible promoter may be induced by zinc or a zinc ion. In still another embodiment, the inducible promoter may be induced by cadmium or a cadmium ion. In yet still another embodiment, the inducible promoter may be induced by mercury or a mercury ion. In an alternative embodiment, the inducible promoter may be induced by gold or a gold ion. In another alternative embodiment, the inducible promoter may be induced by silver or a silver ion. In yet another alternative embodiment, the inducible promoter may be induced by cobalt or a cobalt ion. In still another alternative embodiment, the inducible promoter may be induced by bismuth or a bismuth ion.

In some embodiments, the promoter is induced by exposing a cell comprising the inducible promoter to a metal or metal ion. The cell may be exposed to the metal or metal ion by adding the metal to the microbial growth media. In certain embodiments, the metal or metal ion added to the microbial growth media may be efficiently recovered from the media. In other embodiments, the metal or metal ion remaining in the media after recovery does not substantially impede downstream processing of the media or of the bacterial gene products.

Further non-limiting examples of constitutive promoters include constitutive promoters from Gram-negative bacteria or a bacteriophage propagating in a Gram-negative bacterium. For instance, promoters for genes encoding highly expressed Gram-negative gene products may be used, such as the promoter for Lpp, OmpA, rRNA, and ribosomal proteins. Alternatively, regulatable promoters may be used in a strain that lacks the regulatory protein for that promoter. For instance $P_{lac}$, $P_{tac}$, and $P_{trc}$, may be used as constitutive promoters in strains that lack LacI. Similarly, P22 $P_R$ and $P_L$ may be used in strains that lack the lambda C2 repressor protein, and lambda $P_R$ and $P_L$ may be used in strains that lack the lambda C1 repressor protein. In one embodiment, the constitutive promoter is from a bacteriophage. In another embodiment, the constitutive promoter is from a Salmonella bacteriophage. In yet another embodiment, the constitutive promoter is from a cyanophage. In some embodiments, the constitutive promoter is a Synechocystis promoter. For instance, the constitutive promoter may be the PpsbAll promoter or its variant sequences, the Prbc promoter or its variant sequences, the $P_{cpc}$ promoter or its variant sequences, and the PrnpB promoter or its variant sequences.

E. Host Cells

Also provided are host cells transformed with the nucleic acid molecules or vectors disclosed herein, and descendants thereof. In some embodiments the host cells are microbial cells. In some embodiments, the host cells carry the nucleic acid sequences on vectors, which may but need not be freely replicating vectors. In other embodiments, the nucleic acids have been integrated into the genome of the host cells and/or into an endogenous plasmid of the host cells. The transformed host cells find use, e.g., in the production of recombinant nutritive proteins disclosed herein.

"Microorganisms" includes prokaryotic and eukaryotic microbial species from the Domains Archaea, Bacteria and Eucarya, the latter including yeast and filamentous fungi, protozoa, algae, or higher Protista. The terms "microbial cells" and "microbes" are used interchangeably with the term microorganism.

A variety of host microorganisms may be transformed with a nucleic acid sequence disclosed herein and may in some embodiments be used to produce a recombinant nutritive protein disclosed herein. Suitable host microorganisms include both autotrophic and heterotrophic microbes. In some applications the autotrophic microorganisms allows for a reduction in the fossil fuel and/or electricity inputs required to make a nutritive protein encoded by a recombinant nucleic acid sequence introduced into the host microorganism. This, in turn, in some applications reduces the cost and/or the environmental impact of producing the nutritive protein and/or reduces the cost and/or the environmental impact in comparison to the cost and/or environmental impact of manufacturing alternative nutritive proteins, such as whey, egg, and soy. For example, the cost and/or environmental impact of making a nutritive protein disclosed herein using a host microorganism as disclosed herein is in some embodiments lower that the cost and/or environmental impact of making whey protein in a form suitable for human consumption by processing of cows milk.

Non-limiting examples of heterotrophs include *Escherichia coli, Salmonella typhimurium, Bacillus subtilis, Bacillus megaterium, Corynebacterium glutamicum, Streptomyces coelicolor, Streptomyces lividans, Streptomyces vanezuelae, Streptomyces roseosporus, Streptomyces fradiae, Streptomyces griseus, Streptomyces calvuligerus, Streptomyces hygroscopicus, Streptomyces platensis, Saccharopolyspora erythraea, Corynebacterium glutamicum, Aspergillus niger, Aspergillus nidulans, Aspergillus oryzae, Aspergillus terreus, Aspergillus sojae, Penicillium chrysogenum, Trichoderma reesei, Clostridium acetobutylicum, Clostridium beijerinckii, Clostridium thermocellum, Fusibacter paucivorans, Saccharomyces cerevisiae, Saccharomyces boulardii, Pichia pastoris*, and *Pichia stipitis*.

Photoautotrophic microrganisms include eukaryotic algae, as well as prokaryotic cyanobacteria, green-sulfur bacteria, green non-sulfur bacteria, purple sulfur bacteria, and purple non-sulfur bacteria.

Extremophiles are also contemplated as suitable organisms. Such organisms withstand various environmental parameters such as temperature, radiation, pressure, gravity, vacuum, desiccation, salinity, pH, oxygen tension, and chemicals. They include hyperthermophiles, which grow at or above 80° C. such as *Pyrolobus fumarii*; thermophiles, which grow between 60-80° C. such as *Synechococcus lividis*; mesophiles, which grow between 15-60° C.; and psychrophiles, which grow at or below 15° C. such as *Psychrobacter* and some insects. Radiation tolerant organisms include *Deinococcus radiodurans*. Pressure-tolerant organisms include piezophiles, which tolerate pressure of 130 MPa. Weight-tolerant organisms include barophiles. Hypergravity (e.g., >1 g) hypogravity (e.g., <1 g) tolerant organisms are also contemplated. Vacuum tolerant organisms include tardigrades, insects, microbes and seeds. Dessicant tolerant and anhydrobiotic organisms include xerophiles such as *Artemia salina*; nematodes, microbes, fungi and lichens. Salt-tolerant organisms include halophiles (e.g., 2-5 M NaCl) *Halobacteriacea* and *Dunaliella salina*. pH-tolerant organisms include alkaliphiles such as *Natronobacterium, Bacillus firmus* OF4, *Spirulina* spp. (e.g., pH>9) and acidophiles such as *Cyanidium caldarium, Ferroplasma* sp. (e.g., low pH). Anaerobes, which cannot tolerate $O_2$ such as *Methanococcus jannaschii*; microaerophils, which tolerate some $O_2$ such as *Clostridium* and aerobes, which require $O_2$ are also contemplated. Gas-tolerant organisms, which tolerate pure $CO_2$ include *Cyanidium caldarium* and metal tolerant organisms include metalotolerants such as *Ferroplasma acidarmanus* (e.g., Cu, As, Cd, Zn), *Ralstonia* sp. CH34 (e.g., Zn, Co, Cd, Hg, Pb). Gross, Michael. *Life on the Edge: Amazing Creatures Thriving in Extreme Environments*. New York: Plenum (1998) and Seckbach, J. "Search for Life in the Universe with Terrestrial Microbes Which Thrive Under Extreme Conditions." In Cristiano Batalli Cosmovici, Stuart Bowyer, and Dan Wertheimer, eds., *Astronomical and Biochemical Origins and the Search for Life in the Universe*, p. 511. Milan: Editrice Compositori (1997).

Mixotrophic organisms are also suitable organisms. Mixotrophic organisms can utilize a mix of different sources of energy and carbon, for example, photo- and chemotrophy, litho- and organotrophy, auto- and heterotrophy, and combinations thereof or a combination of it. Mixotrophs can be either eukaryotic or prokaryotic. Additionally, mixotrophs can be obligate or facultative. Suitable mixotrophic organisms include mixotrophic algae and mixotrophic bacteria.

Algae and cyanobacteria include but are not limited to the following genera: *Acanthoceras, Acanthococcus, Acaryochloris, Achnanthes, Achnanthidium, Actinastrum, Actinochloris, Actinocyclus, Actinotaenium, Amphichrysis, Amphidinium, Amphikrikos, Amphipleura, Amphiprora, Amphithrix, Amphora, Anabaena, Anabaenopsis, Aneumastus, Ankistrodesmus, Ankyra, Anomoeoneis, Apatococcus, Aphanizomenon, Aphanocapsa, Aphanochaete, Aphanothece, Apiocystis, Apistonema, Arthrodesmus, Artherospira, Ascochloris, Asterionella, Asterococcus, Audouinella, Aulacoseira, Bacillaria, Balbiania, Bambusina, Bangia, Basichlamys, Batrachospermum, Binuclearia, Bitrichia, Blidingia, Botrdiopsis, Botrydium, Botryococcus, Botryosphaerella, Brachiomonas, Brachysira, Brachytrichia, Brebissonia, Bulbochaete, Bumilleria, Bumilleriopsis, Caloneis, Calothrix, Campylodiscus, Capsosiphon, Carteria, Catena, Cavinula, Centritractus, Centronella, Ceratium, Chaetoceros, Chaetochloris, Chaetomorpha, Chaetonella, Chaetonema, Chaetopeltis, Chaetophora, Chaetosphaeridium, Chamaesiphon, Chara, Characiochloris, Characiopsis, Characium, Charales, Chilomonas, Chlainomonas, Chlamydoblepharis, Chlamydocapsa, Chlamydomonas, Chlamydomonopsis, Chlamydomyxa, Chlamydonephris, Chlorangiella, Chlorangiopsis, Chlorella, Chlorobotrys, Chlorobrachis, Chlorochytrium, Chlorococcum, Chlorogloea, Chlorogloeopsis, Chlorogonium, Chlorolobion, Chloromonas, Chlorophysema, Chlorophyta, Chlorosaccus, Chlorosarcina, Choricystis, Chromophyton, Chromulina, Chroococcidiopsis, Chroococcus, Chroodactylon, Chroomonas, Chroothece, Chrysamoeba, Chrysapsis, Chrysidiastrum, Chrysocapsa, Chrysocapsella, Chrysochaete, Chrysochromulina, Chrysococcus, Chrysocrinus, Chrysolepidomonas, Chrysolykos, Chrysonebula, Chrysophyta, Chrysopyxis, Chrysosaccus, Chrysophaerella, Chrysostephanosphaera, Clodophora, Clastidium, Closteriopsis, Closterium, Coccomyxa, Cocconeis, Coelastrella, Coelastrum, Coelosphaerium, Coenochloris, Coenococcus, Coenocystis, Colacium, Coleochaete, Collodictyon, Compsogonopsis, Compsopogon, Conjugatophyta, Conochaete, Coronastrum, Cosmarium, Cosmioneis, Cosmocladium, Crateriportula, Craticula, Crinalium, Crucigenia, Crucigeniella, Cryptoaulax, Cryptomonas, Cryptophyta, Cteno-*

*phora, Cyanodictyon, Cyanonephron, Cyanophora, Cyanophyta, Cyanothece, Cyanothomonas, Cyclonexis, Cyclostephanos, Cyclotella, Cylindrocapsa, Cylindrocystis, Cylindrospermum, Cylindrotheca, Cymatopleura, Cymbella, Cymbellonitzschia, Cystodinium Dactylococcopsis, Debarya, Denticula, Dermatochrysis, Dermocarpa, Dermocarpella, Desmatractum, Desmidium, Desmococcus, Desmonema, Desmosiphon, Diacanthos, Diacronema, Diadesmis, Diatoma, Diatomella, Dicellula, Dichothrix, Dichotomococcus, Dicranochaete, Dictyochloris, Dictyococcus, Dictyosphaerium, Didymocystis, Didymogenes, Didymosphenia, Dilabifilum, Dimorphococcus, Dinobryon, Dinococcus, Diplochloris, Diploneis, Diplostauron, Distrionella, Docidium, Draparnaldia, Dunaliella, Dysmorphococcus, Ecballocystis, Elakatothrix, Ellerbeckia, Encyonema, Enteromorpha, Entocladia, Entomoneis, Entophysalis, Epichrysis, Epipyxis, Epithemia, Eremosphaera, Euastropsis, Euastrum, Eucapsis, Eucocconeis, Eudorina, Euglena, Euglenophyta, Eunotia, Eustigmatophyta, Eutreptia, Fallacia, Fischerella, Fragilaria, Fragilariforma, Franceia, Frustulia, Curcilla, Geminella, Genicularia, Glaucocystis, Glaucophyta, Glenodiniopsis, Glenodinium, Gloeocapsa, Gloeochaete, Gloeochrysis, Gloeococcus, Gloeocystis, Gloeodendron, Gloeomonas, Gloeoplax, Gloeothece, Gloeotila, Gloeotrichia, Gloiodictyon, Golenkinia, Golenkiniopsis, Gomontia, Gomphocymbella, Gomphonema, Gomphosphaeria, Gonatozygon, Gongrosia, Gongrosira, Goniochloris, Gonium, Gonyostomum, Granulochloris, Granulocystopsis, Groenbladia, Gymnodinium, Gymnozyga, Gyrosigma, Haematococcus, Hafniomonas, Hallassia, Hammatoidea, Hannaea, Hantzschia, Hapalosiphon, Haplotaenium, Haptophyta, Haslea, Hemidinium, Hemitoma, Heribaudiella, Heteromastix, Heterothrix, Hibberdia, Hildenbrandia, Hillea, Holopedium, Homoeothrix, Hormanthonema, Hormotila, Hyalobrachion, Hyalocardium, Hyalodiscus, Hyalogonium, Hyalotheca, Hydrianum, Hydrococcus, Hydrocoleum, Hydrocoryne, Hydrodictyon, Hydrosera, Hydrurus, Hyella, Hymenomonas, Isthmochloron, Johannesbaptistia, Juranyiella, Karayevia, Kathablepharis, Katodinium, Kephyrion, Keratococcus, Kirchneriella, Klebsormidium, Kolbesia, Koliella, Komarekia, Korshikoviella, Kraskella, Lagerheimia, Lagynion, Lamprothamnium, Lemanea, Lepocinclis, Leptosira, Lobococcus, Lobocystis, Lobomonas, Luticola, Lyngbya, Malleochloris, Mallomonas, Mantoniella, Marssoniella, Martyana, Mastigocoleus, Gastogloia, Melosira, Merismopedia, Mesostigma, Mesotaenium, Micractinium, Micrasterias, Microchaete, Microcoleus, Microcystis, Microglena, Micromonas, Microspora, Microthamnion, Mischococcus, Monochrysis, Monodus, Monomastix, Monoraphidium, Monostroma, Mougeotia, Mougeotiopsis, Myochloris, Myromecia, Myxosarcina, Naegeliella, Nannochloris, Nautococcus, Navicula, Neglectella, Neidium, Nephroclamys, Nephrocytium, Nephrodiella, Nephroselmis, Netrium, Nitella, Nitellopsis, Nitzschia, Nodularia, Nostoc, Ochromonas, Oedogonium, Oligochaetophora, Onychonema, Oocardium, Oocystis, Opephora, Ophiocytium, Orthoseira, Oscillatoria, Oxyneis, Pachycladella, Palmella, Palmodictyon, Pnadorina, Pannus, Paralia, Pascherina, Paulschulzia, Pediastrum, Pedinella, Pedinomonas, Pedinopera, Pelagodictyon, Penium, Peranema, Peridiniopsis, Peridinium, Peronia, Petroneis, Phacotus, Phacus, Phaeaster, Phaeodermatium, Phaeophyta, Phaeosphaera, Phaeothamnion, Phormidium, Phycopeltis, Phyllariochloris, Phyllocardium, Phyllomitas, Pinnularia, Pitophora, Placoneis, Planctonema, Planktosphaeria, Planothidium, Plectonema, Pleodorina, Pleurastrum, Pleurocapsa, Pleurocladia, Pleurodiscus, Pleurosigma, Pleurosira, Pleurotaenium, Pocillomonas, Podohedra, Polyblepharides, Polychaetophora, Polyedriella, Polyedriopsis, Polygoniochloris, Polyepidomonas, Polytaenia, Polytoma, Polytomella, Porphyridium, Posteriochromonas, Prasinochloris, Prasinocladus, Prasinophyta, Prasiola, Prochlorphyta, Prochlorothrix, Protoderma, Protosiphon, Provasoliella, Prymnesium, Psammodictyon, Psammothidium, Pseudanabaena, Pseudenoclonium, Psuedocarteria, Pseudochate, Pseudocharacium, Pseudococcomyxa, Pseudodictyosphaerium, Pseudokephyrion, Pseudoncobyrsa, Pseudoquadrigula, Pseudosphaerocystis, Pseudostaurastrum, Pseudostaurosira, Pseudotetrastrum, Pteromonas, Punctastruata, Pyramichlamys, Pyramimonas, Pyrrophyta, Quadrichloris, Quadricoccus, Quadrigula, Radiococcus, Radiofilum, Raphidiopsis, Raphidocelis, Raphidonema, Raphidophyta, Peimeria, Rhabdoderma, Rhabdomonas, Rhizoclonium, Rhodomonas, Rhodophyta, Rhoicosphenia, Rhopalodia, Rivularia, Rosenvingiella, Rossithidium, Roya, Scenedesmus, Scherffelia, Schizochlamydella, Schizochlamys, Schizomeris, Schizothrix, Schroederia, Scolioneis, Scotiella, Scotiellopsis, Scourfieldia, Scytonema, Selenastrum, Selenochloris, Sellaphora, Semiorbis, Siderocelis, Diderocystopsis, Dimonsenia, Siphononema, Sirocladium, Sirogonium, Skeletonema, Sorastrum, Spennatozopsis, Sphaerellocystis, Sphaerellopsis, Sphaerodinium, Sphaeroplea, Sphaerozosma, Spiniferomonas, Spirogyra, Spirotaenia, Spirulina, Spondylomorum, Spondylosium, Sporotetras, Spumella, Staurastrum, Stauerodesmus, Stauroneis, Staurosira, Staurosirella, Stenopterobia, Stephanocostis, Stephanodiscus, Stephanoporos, Stephanosphaera, Stichococcus, Stichogloea, Stigeoclonium, Stigonema, Stipitococcus, Stokesiella, Strombomonas, Stylochrysalis, Stylodinium, Styloyxis, Stylosphaeridium, Surirella, Sykidion, Symploca, Synechococcus, Synechocystis, Synedra, Synochromonas, Synura, Tabellaria, Tabularia, Teilingia, Temnogametum, Tetmemorus, Tetrachlorella, Tetracyclus, Tetradesmus, Tetraedriella, Tetraedron, Tetraselmis, Tetraspora, Tetrastrum, Thalassiosira, Thamniochaete, Thorakochloris, Thorea, Tolypella, Tolypothrix, Trachelomonas, Trachydiscus, Trebouxia, Trentepholia, Treubaria, Tribonema, Trichodesmium, Trichodiscus, Trochiscia, Tryblionella, Ulothrix, Uroglena, Uronema, Urosolenia, Urospora, Uva, Vacuolaria, Vaucheria, Volvox, Volvulina, Westella, Woloszynskia, Xanthidium, Xanthophyta, Xenococcus, Zygnema, Zygnemopsis, and Zygonium.*

Additional cyanobacteria include members of the genus *Chamaesiphon, Chroococcus, Cyanobacterium, Cyanobium, Cyanothece, Dactylococcopsis, Gloeobacter, Gloeocapsa, Gloeothece, Microcystis, Prochlorococcus, Prochloron, Synechococcus, Synechocystis, Cyanocystis, Dermocarpella, Stanieria, Xenococcus, Chroococcidiopsis, Myxosarcina, Arthrospira, Borzia, Crinalium, Geitlerinemia, Leptolyngbya, Limnothrix, Lyngbya, Microcoleus, Oscillatoria, Planktothrix, Prochlorothrix, Pseudanabaena, Spirulina, Starria, Symploca, Trichodesmium, Tychonema, Anabaena, Anabaenopsis, Aphanizomenon, Cyanospira, Cylindrospermopsis, Cylindrospermum, Nodularia, Nostoc, Scylonema, Calothrix, Rivularia, Tolypothrix, Chlorogloeopsis, Fischerella, Geitieria, Iyengariella, Nostochopsis, Stigonema* and *Thermosynechococcus.*

Green non-sulfur bacteria include but are not limited to the following genera: *Chloroflexus, Chloronema, Oscillochloris, Heliothrix, Herpetosiphon, Roseiflexus,* and *Thermomicrobium.*

Green sulfur bacteria include but are not limited to the following genera: *Chlorobium, Clathrochloris,* and *Prosthecochloris.*

Purple sulfur bacteria include but are not limited to the following genera: *Allochromatium, Chromatium, Halochromatium, Isochromatium, Marichromatium, Rhodovulum, Thermochromatium, Thiocapsa, Thiorhodococcus*, and *Thiocystis*.

Purple non-sulfur bacteria include but are not limited to the following genera: *Phaeospirillum, Rhodobaca, Rhodobacter, Rhodomicrobium, Rhodopila, Rhodopseudomonas, Rhodothalassium, Rhodospirillum, Rodovibrio*, and *Roseospira*.

Aerobic chemolithotrophic bacteria include but are not limited to nitrifying bacteria such as *Nitrobacteraceae* sp., *Nitrobacter* sp., *Nitrospina* sp., *Nitrococcus* sp., *Nitrospira* sp., *Nitrosomonas* sp., *Nitrosococcus* sp., *Nitrosospira* sp., *Nitrosolobus* sp., *Nitrosovibrio* sp.; colorless sulfur bacteria such as, *Thiovulum* sp., *Thiobacillus* sp., *Thiomicrospira* sp., *Thiosphaera* sp., *Thermothrix* sp.; obligately chemolithotrophic hydrogen bacteria such as *Hydrogenobacter* sp., iron and manganese-oxidizing and/or depositing bacteria such as *Siderococcus* sp., and magnetotactic bacteria such as *Aquaspirillum* sp.

Archaeobacteria include but are not limited to methanogenic archaeobacteria such as *Methanobacterium* sp., *Methanobrevibacter* sp., *Methanothermus* sp., *Methanococcus* sp., *Methanomicrobium* sp., *Methanospirillum* sp., *Methanogenium* sp., *Methanosarcina* sp., *Methanolobus* sp., *Methanothrix* sp., *Methanococcoides* sp., *Methanoplanus* sp.; extremely thermophilic S-Metabolizers such as *Thermoproteus* sp., *Pyrodictium* sp., *Sulfolobus* sp., *Acidianus* sp. and other microorganisms such as, *Bacillus subtilis, Saccharomyces cerevisiae, Streptomyces* sp., *Ralstonia* sp., *Rhodococcus* sp., *Corynebacteria* sp., *Brevibacteria* sp., *Mycobacteria* sp., and oleaginous yeast.

Yet other suitable organisms include synthetic cells or cells produced by synthetic genomes as described in Venter et al. US Pat. Pub. No. 2007/0264688, and cell-like systems or synthetic cells as described in Glass et al. US Pat. Pub. No. 2007/0269862.

Still other suitable organisms include *Escherichia coli, Acetobacter aceti, Bacillus subtilis*, yeast and fungi such as *Clostridium ljungdahlii, Clostridium thermocellum, Penicillium chrysogenum, Pichia pastoris, Saccharomyces cerevisiae, Schizosaccharomyces pombe, Pseudomonas fluorescens*, or *Zymomonas mobilis*. In some embodiments those organisms are engineered to fix carbon dioxide while in other embodiments they are not.

In some embodiments eukaryotic cells, such as insect cells or mammalian cells, such as human cells are used as host cells. Vectors and expression control sequences including promoters and enhancers are well known for such cells. Examples of useful mammalian host cell lines for this purpose are monkey kidney CV1 line transformed by SV40 (COS-7, ATCC CRL 1651); human embryonic kidney line (293 or 293 cells subcloned for growth in suspension culture, Graham et al., J. Gen Virol. 36:59 (1977)); baby hamster kidney cells (BHK, ATCC CCL 10); Chinese hamster ovary cells/−DHFR (CHO, Urlaub et al., Proc. Natl. Acad. Sci. USA 77:4216 (1980)); mouse sertoli cells (TM4, Mather, Biol. Reprod. 23:243-251 (1980)); monkey kidney cells (CV1 ATCC CCL 70); African green monkey kidney cells (VERO-76, ATCC CRL-1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2, HB 8065); mouse mammary tumor (MMT 060562, ATCC CCL51); TRI cells (Mather et al., Annals N.Y. Acad. Sci. 383:44-68 (1982)); MRC 5 cells; FS4 cells; and a human hepatoma line (Hep G2).

F. Production of Recombinant Nutritive Proteins

Skilled artisans are aware of many suitable methods available for culturing recombinant cells to produce (and optionally secrete) a recombinant nutritive protein as disclosed herein, as well as for purification and/or isolation of expressed recombinant proteins. The methods chosen for protein purification depend on many variables, including the properties of the protein of interest, its location and form within the cell, the vector, host strain background, and the intended application for the expressed protein. Culture conditions can also have an effect on solubility and localization of a given target protein. Many approaches can be used to purify target proteins expressed in recombinant microbial cells as disclosed herein, including without limitation ion exchange and gel filtration.

In some embodiments a peptide fusion tag is added to the recombinant protein making possible a variety of affinity purification methods that take advantage of the peptide fusion tag. In some embodiments, the use of an affinity method enables the purification of the target protein to near homogeneity in one step. Purification may include cleavage of part or all of the fusion tag with enterokinase, factor Xa, thrombin, or HRV 3C proteases, for example. In some embodiments, before purification or activity measurements of an expressed target protein, preliminary analysis of expression levels, cellular localization, and solubility of the target protein is performed. The target protein may be found in any or all of the following fractions: soluble or insoluble cytoplasmic fractions, periplasm, or medium. Depending on the intended application, preferential localization to inclusion bodies, medium, or the periplasmic space can be advantageous, in some embodiments, for rapid purification by relatively simple procedures.

While *Escherichia coli* is widely regarded as a robust host for heterologous protein expression, it is also widely known that over-expression of many proteins in this host is prone to aggregation in the form of insoluble inclusion bodies. One of the most commonly used methods for either rescuing inclusion body formation, or to improve the titer of the protein itself, is to include an amino-terminal maltose-binding protein (MBP) [Austin B P, Nallamsetty S, Waugh D S. Hexahistidine-tagged maltose-binding protein as a fusion partner for the production of soluble recombinant proteins in *Escherichia coli*. Methods Mol. Biol. 2009; 498:157-72], or small ubiquitin-related modifier (SUMO) [Saitoh H, Uwada J, Azusa K. Strategies for the expression of SUMO-modified target proteins in *Escherichia coli*. Methods Mol. Biol. 2009; 497:211-21; Malakhov M P, Mattern M R, Malakhova O A, Drinker M, Weeks S D, Butt T R. SUMO fusions and SUMO-specific protease for efficient expression and purification of proteins. J Struct Funct Genomics. 2004; 5(1-2):75-86; Panavas T, Sanders C, Butt T R. SUMO fusion technology for enhanced protein production in prokaryotic and eukaryotic expression systems. Methods Mol Biol. 2009; 497:303-17] fusion to the protein of interest. These two proteins are expressed extremely well, and in the soluble form, in *Escherichia coli* such that the protein of interest is also effectively produced in the soluble form. The protein of interest can be cleaved by designing a site specific protease recognition sequence (such as the tobacco etch virus (TEV) protease) in-between the protein of interest and the fusion protein [1].

In some embodiments the recombinant protein is initially not folded correctly or is insoluble. A variety of methods are well known for refolding of insoluble proteins. Most protocols comprise the isolation of insoluble inclusion bodies by centrifugation followed by solubilization under denaturing conditions. The protein is then dialyzed or diluted into a non-denaturing buffer where refolding occurs. Because every protein possesses unique folding properties, the optimal refolding protocol for any given protein can be empirically determined by a skilled artisan. Optimal refolding conditions can, for example, be rapidly determined on a small scale by a matrix approach, in which variables such as protein concentration, reducing agent, redox treatment, divalent cations, etc., are tested. Once the optimal concentrations are found, they can be applied to a larger scale solubilization and refolding of the target protein.

In some embodiments the nutritive protein does not comprise a tertiary structure. In some embodiments less than half of the amino acids in the nutritive protein participate in a tertiary structure. In some embodiments the nutritive protein does not comprise a secondary structure. In some embodiments less than half of the amino acids in the nutritive protein participate in a secondary structure. Recombinant nutritive proteins may be isolated from a culture of cells expressing them in a state that comprises one or more of these structural features. In some embodiments the tertiary structure of a recombinant nutritive protein is reduced or eliminated after the protein is isolated from a culture producing it. In some embodiments the secondary structure of a recombinant nutritive protein is reduced or eliminated after the protein is isolated from a culture producing it.

In some embodiments a CAPS buffer at alkaline pH in combination with N-lauroylsarcosine is used to achieve solubility of the inclusion bodies, followed by dialysis in the presence of DTT to promote refolding. Depending on the target protein, expression conditions, and intended application, proteins solubilized from washed inclusion bodies may be >90% homogeneous and may not require further purification. Purification under fully denaturing conditions (before refolding) is possible using His.Tag® fusion proteins and His.Bind® immobilized metal affinity chromatography (Novogen®). In addition, S.Tag™, T7.Tag®, and Strep.Tag® II fusion proteins solubilized from inclusion bodies using 6 M urea can be purified under partially denaturing conditions by dilution to 2 M urea (S.Tag and T7.Tag) or 1 M urea (Strep.Tag II) prior to chromatography on the appropriate resin. Refolded fusion proteins can be affinity purified under native conditions using His.Tag, S.Tag, Strep.Tag II, and other appropriate affinity tags (e.g., GST.Tag™, and T7.Tag) (Novogen®).

In some embodiments the recombinant nutritive protein is an endogenous protein of the host cell used to express it. That is, the cellular genome of the host cell comprises an open reading frame that encodes the recombinant nutritive protein. In some embodiments regulatory sequences sufficient to increase expression of the nutritive protein are inserted into the host cell genome and operatively linked to the endogenous open reading frame such that the regulatory sequences drive overexpression of the recombinant nutritive protein from a recombinant nucleic acid. In some embodiments heterologous nucleic acid sequences are fused to the endogenous open reading frame of the nutritive protein and cause the nutritive protein to be synthesized comprising a heterologous amino acid sequence that changes the cellular trafficking of the recombinant nutritive protein, such as directing it to an organelle or to a secretion pathway. In some embodiments an open reading frame that encodes the endogeneous host cell protein is introduced into the host cell on a plasmid that further comprises regulatory sequences operatively linked to the open reading frame. In some embodiments the recombinant host cell expresses at least 2 times, at least 3 times, at least 4 times, at least 5 times, at least 10 times, or at least 20 times, at least 30 times, at least 40 times, at least 50 times, or at least 100 times more of the recombinant nutritive protein than the amount of the nutritive protein produced by a similar host cell grown under similar conditions.

In some embodiments nutritive proteins of this disclosure are synthesized chemically without the use of a recombinant production system. Protein synthesis can be carried out in a liquid-phase system or in a solid-phase system using techniques known in the art (see, e.g., Atherton, E., Sheppard, R. C. (1989). Solid Phase peptide synthesis: a practical approach. Oxford, England: IRL Press; Stewart, J. M., Young, J. D. (1984). Solid phase peptide synthesis (2nd ed.). Rockford: Pierce Chemical Company).

G. Production of Recombinant Nutritive Proteins in Plants

The nucleic acid molecules comprising a nucleic acid sequence encoding a nutritive protein of this disclosure enable production of transgenic plants comprising the nucleic acid sequence. Accordingly, this disclosure also provides plant comprising a recombinant nucleic acid molecule comprising a nucleic acid sequence encoding a nutritive protein of this disclosure. The plant can be any plant that is subject to transformation and regeneration and include, but are not limited to, *Acacia*, alfalfa, aneth, apple, apricot, artichoke, arugula, asparagus, avocado, banana, barley, beans, beet, blackberry, blueberry, broccoli, brussels sprouts, cabbage, canola, cantaloupe, carrot, cassaya, cauliflower, celery, Chinese cabbage, cherry, cilantro, citrus, clementines, coffee, corn, cotton, cucumber, Douglas fir, eggplant, endive, escarole, eucalyptus, fennel, figs, forest trees, gourd, grape, grapefruit, honey dew, jicama, kiwifruit, lettuce, leeks, lemon, lime, Loblolly pine, mango, melon, mushroom, nut, oat, okra, onion, orange, an ornamental plant, papaya, parsley, pea, peach, peanut, pear, pepper, persimmon, pine, pineapple, plantain, plum, pomegranate, poplar, potato, pumpkin, quince, radiata pine, radicchio, radish, rapeseed, raspberry, rice, rye, sorghum, Southern pine, soybean, spinach, squash, strawberry, sugarbeet, sugarcane, sunflower, sweet corn, sweet potato, sweetgum, tangerine, tea, tobacco, tomato, turf, a vine, watermelon, wheat, yams, and zucchini. In preferred embodiments, the plant is a bean, broccoli, cabbage, canola, carrot, cauliflower, celery, Chinese cabbage, corn, cotton cucumber, eggplant, leek, lettuce, melon, pea, pepper, pumpkin, radish, spinach, soybean, squash, sugarcane, sweet corn, tomato, watermelon, and wheat plant. In some embodiments, the plant is a corn plant. In some embodiments, the plant is a soybean plant. In some embodiments, the plant is a cotton plant. In some embodiments, the plant is a canola plant. In some embodiments the plant is a member of a genus selected from *Arabidopsis, Beta, Glycine, Jatropha, Miscanthus, Panicum, Phalaris, Populus, Saccharum, Salix, Simmondsia* and *Zea*.

Numerous promoters that are active in plant cells have been described in the literature. These include promoters present in plant genomes as well as promoters from other sources, including nopaline synthase (NOS) promoter and octopine synthase (OCS) promoters carried on tumor-inducing plasmids of *Agrobacterium tumefaciens*, caulimovirus promoters such as the cauliflower mosaic virus. For instance, see U.S. Pat. Nos. 5,858,742 and 5,322,938, which disclose versions of the constitutive promoter derived from cauliflower mosaic virus (CaMV35S), U.S. Pat. No. 5,641,876, which discloses a rice actin promoter, U.S. Patent Application Publication 2002/0192813A1, which discloses 5',3' and intron elements useful in the design of effective plant expression vectors, U.S. patent application Ser. No. 09/757,089, which discloses a maize chloroplast aldolase promoter, U.S. patent application Ser. No. 08/706,946, which discloses a rice glutelin promoter, U.S. patent application Ser. No. 09/757,089, which discloses a maize aldolase (FDA) promoter, and U.S. patent application Ser. No. 60/310,370, which discloses a maize nicotianamine synthase promoter. These and numerous other promoters that function in plant cells are known to those skilled in the art and available for use in recombinant nucleic acids to provide for expression of nutritive proteins in transgenic plants.

For some applications preferential expression in plant green tissues is desired. Promoters of interest for such uses include those from genes such as *Arabidopsis thaliana* ribulose-1,5-bisphosphate carboxylase (Rubisco) small subunit (Fischhoff et al. (1992) Plant Mol. Biol. 20:81-93), aldolase and pyruvate orthophosphate dikinase (PPDK) (Taniguchi et al. (2000) Plant Cell Physiol. 41(1):42-48).

Furthermore, the promoters may be altered to contain at least one enhancer sequence to assist in elevating gene expression. Such enhancers are known in the art. By including an enhancer sequence with such constructs, the expression of the nutritive protein may be enhanced. These enhancers often are found 5' to the start of transcription in a promoter that functions in eukaryotic cells, but can often be inserted upstream (5') or downstream (3') to the coding sequence. In some instances, these 5' enhancing elements are introns. Particularly useful as enhancers are the 5' introns of the rice actin 1 (see U.S. Pat. No. 5,641,876) and rice actin 2 genes, the maize alcohol dehydrogenase gene intron, the maize heat shock protein 70 gene intron (U.S. Pat. No. 5,593,874) and the maize shrunken 1 gene.

For some applications expression in plant seed tissues is desired to effect modify seed composition. Exemplary promoters for use for seed composition modification include promoters from seed genes such as napin (U.S. Pat. No. 5,420,034), maize L3 oleosin (U.S. Pat. No. 6,433,252), zein Z27 (Russell et al. (1997) Transgenic Res. 6(2):157-166), globulin 1 (Belanger et al (1991) Genetics 129:863-872), glutelin 1 (Russell (1997) supra), and peroxiredoxin antioxidant (Perl) (Stacy et al. (1996) Plant Mol. Biol. 31(6):1205-1216)

Recombinant nucleic acid constructs prepared in accordance with the disclosure will also generally include a 3' element that typically contains a polyadenylation signal and site. Well-known 3' elements include those from *Agrobacterium tumefaciens* genes such as nos 3', tml 3', tmr 3', tms 3', ocs 3', tr7 3', for example disclosed in U.S. Pat. No. 6,090,627; 3' elements from plant genes such as wheat (*Triticum aesevitum*) heat shock protein 17 (Hsp17 3'), a wheat ubiquitin gene, a wheat fructose-1,6-biphosphatase gene, a rice glutelin gene a rice lactate dehydrogenase gene and a rice beta-tubulin gene, all of which are disclosed in U.S. published patent application 2002/0192813 A1; and the pea (*Pisum sativum*) ribulose biphosphate carboxylase gene (rbs 3'), and 3' elements from the genes within the host plant.

Constructs and vectors may also include a transit peptide for targeting of a gene target to a plant organelle, particularly to a chloroplast, leucoplast or other plastid organelle. For descriptions of the use of chloroplast transit peptides see U.S. Pat. No. 5,188,642 and U.S. Pat. No. 5,728,925. For description of the transit peptide region of an *Arabidopsis* EPSPS gene, see Klee, H. J. et al (MGG (1987) 210:437-442).

Numerous methods for transforming plant cells with recombinant DNA are known in the art and may be used in the present disclosure. Two commonly used methods for plant transformation are *Agrobacterium*-mediated transformation and microprojectile bombardment. Microprojectile bombardment methods are illustrated in U.S. Pat. No. 5,015,580 (soybean); U.S. Pat. No. 5,550,318 (corn); U.S. Pat. No. 5,538,880 (corn); U.S. Pat. No. 5,914,451 (soybean); U.S. Pat. No. 6,160,208 (corn); U.S. Pat. No. 6,399,861 (corn) and U.S. Pat. No. 6,153,812 (wheat) and *Agrobacterium*-mediated transformation is described in U.S. Pat. No. 5,159,135 (cotton); U.S. Pat. No. 5,824,877 (soybean); U.S. Pat. No. 5,591,616 (corn); and U.S. Pat. No. 6,384,301 (soybean). For *Agrobacterium tumefaciens* based plant transformation system, additional elements present on transformation constructs will include T-DNA left and right border sequences to facilitate incorporation of the recombinant polynucleotide into the plant genome.

In general it is useful to introduce recombinant DNA randomly, i.e. at a non-specific location, in the genome of a target plant line. In special cases it may be useful to target recombinant DNA insertion in order to achieve site-specific integration, for example to replace an existing gene in the genome, to use an existing promoter in the plant genome, or to insert a recombinant polynucleotide at a predetermined site known to be active for gene expression. Several site specific recombination systems exist which are known to function in plants, including cre-lox as disclosed in U.S. Pat. No. 4,959,317 and FLP-FRT as disclosed in U.S. Pat. No. 5,527,695.

Transformation methods are generally practiced in tissue culture on media and in a controlled environment. "Media" refers to the numerous nutrient mixtures that are used to grow cells in vitro, that is, outside of the intact living organism. Recipient cell targets include, but are not limited to, meristem cells, callus, immature embryos and gametic cells such as microspores, pollen, sperm and egg cells. It is contemplated that any cell from which a fertile plant may be regenerated is useful as a recipient cell. Callus may be initiated from tissue sources including, but not limited to, immature embryos, seedling apical meristems, microspores and the like. Cells capable of proliferating as callus are also recipient cells for genetic transformation. Practical transformation methods and materials for making transgenic plants of this disclosure, for example various media and recipient target cells, transformation of immature embryo cells and subsequent regeneration of fertile transgenic plants are disclosed in U.S. Pat. Nos. 6,194,636 and 6,232,526.

The seeds of transgenic plants can be harvested from fertile transgenic plants and used to grow progeny generations of transformed plants that produce the recombinant nutritive protein of this disclosure. In addition to direct transformation of a plant with a recombinant DNA, transgenic plants can be prepared by crossing a first plant having a recombinant DNA with a second plant lacking the DNA. For example, recombinant DNA can be introduced into first plant line that is amenable to transformation to produce a transgenic plant which can be crossed with a second plant line to introgress the recombinant DNA into the second plant line. A transgenic plant with recombinant DNA encoding a nutritive protein of this disclosure, can be crossed with transgenic plant line having other recombinant DNA that confers another trait, for example herbicide resistance or pest resistance, or production of a second nutritive product such as an oil, to produce progeny plants having recombinant DNA that confers both traits. Typically, in such breeding for combining traits the transgenic plant donating the additional trait is a male line and the transgenic plant carrying the base traits is the female line. The progeny of this cross will segregate such that some of the plants will carry the DNA for both parental traits and some will carry DNA for one parental trait; such plants can be identified by markers associated with parental recombinant DNA, e.g. marker identification by analysis for recombinant DNA or, in the case where a selectable marker is linked to the recombinant, by application of the selecting agent such as a herbicide for use with a herbicide tolerance marker, or by selection for the enhanced trait. Progeny plants carrying DNA for both parental traits can be crossed back into the female parent line multiple times, for example usually 6 to 8 generations, to produce a progeny plant with substantially the same genotype as one original transgenic parental line but for the recombinant DNA of the other transgenic parental line.

In the practice of transformation DNA is typically introduced into only a small percentage of target plant cells in any one transformation experiment. Marker genes are used to provide an efficient system for identification of those cells that are stably transformed by receiving and integrating a transgenic DNA construct into their genomes. Preferred marker genes provide selective markers which confer resistance to a selective agent, such as an antibiotic or herbicide. Any of the herbicides to which the transformed plants may be resistant are useful agents for selective markers. Potentially transformed cells are exposed to the selective agent. In the population of surviving cells will be those cells where, generally, the resistance-conferring gene is integrated and expressed at sufficient levels to permit cell survival. Cells may be tested further to confirm stable integration of the exogenous DNA. Commonly used selective marker genes include those conferring resistance to antibiotics such as kanamycin and paromomycin (nptII), hygromycin B (aph IV) and gentamycin (aac3 and aacC4) or resistance to herbicides such as glufosinate (bar or pat) and glyphosate (aroA or EPSPS). Examples of such selectable are illustrated in U.S. Pat. Nos. 5,550,318; 5,633,435; 5,780,708 and 6,118,047. Selectable markers which provide an ability to visually identify transformants can also be employed, for example, a gene expressing a colored or fluorescent protein such as a luciferase or green fluorescent protein (GFP) or a gene expressing a beta-glucuronidase or uidA gene (GUS) for which various chromogenic substrates are known.

Plant cells that survive exposure to the selective agent, or plant cells that have been scored positive in a screening assay, may be cultured in regeneration media and allowed to mature into plants. Developing plantlets regenerated from transformed plant cells can be transferred to plant growth mix, and hardened off, for example, in an environmentally controlled chamber. Plants are regenerated from about 6 weeks to 10 months after a transformant is identified, depending on the initial tissue. Plants may be pollinated using conventional plant breeding methods known to those of skill in the art and seed produced, for example self-pollination is commonly used with transgenic corn. The regenerated transformed plant or its progeny seed or plants can be tested for expression of the recombinant DNA and selected for the presence of a heterologous nutritive protein.

Transgenic plants derived from the plant cells of this disclosure are grown to generate transgenic plants comprising the heterologous nucleic acid that encodes a nutritive protein of this disclosure and produce transgenic seed and haploid pollen comprising the heterologous nucleic acid sequence. Such plants with enhanced traits are identified by selection of transformed plants or progeny seed for the enhanced trait. Transgenic plants grown from transgenic seed provided herein demonstrate improved agronomic traits that contribute to increased yield or other traits that provide increased plant value, including, for example, improved protein quality such as increasing the content of at least one of essential amino acids, branch chain amino acids, or Leu.

The transgenic plants are useful as sources of nutritive proteins. For example, in some embodiments a transgenic plant comprising a recombinant nutritive protein of this disclosure comprises an increased weight fraction of total protein compared to a control non-transgenic plant. In some embodiments a transgenic plant comprising a recombinant nutritive protein of this disclosure comprises an increased weight fraction of essential amino acids compared to a control non-transgenic plant. In some embodiments a transgenic plant comprising a recombinant nutritive protein of this disclosure comprises an increased weight fraction of branch chain amino acids compared to a control non-transgenic plant. In some embodiments a transgenic plant comprising a recombinant nutritive protein of this disclosure comprises an increased weight fraction of Leu compared to a control non-transgenic plant. In some embodiments a transgenic plant comprising a recombinant nutritive protein of this disclosure comprises at least one of: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant. In some embodiments a transgenic plant comprising a recombinant nutritive protein of this disclosure comprises: a) an increased ratio of branch chain amino acid residues to total amino acid residues compared to a control non-transgenic plant; b) an increased ratio of Leu residues to total amino acid residues compared to a control non-transgenic plant; and c) an increased ratio of essential amino acid residues to total amino acid residues compared to a control non-transgenic plant.

Accordingly, the transgenic plants are useful as sources of high quality protein. The plants may be harvested and used in mammalian diets with or without further processing. For example, flour made from transgenic wheat, cornmeal made from transgenic corn, or rice or rice flour derived from transgenic rice is enriched in at least one of protein, essential amino acids, branch chain amino acids, and Leu compared to similar products made from plants that do not comprise the recombinant nutritive protein. In some embodiments the recombinant nutritive protein is a plant protein or comprises a polypeptide sequence of a plant protein or a derivative or mutein thereof, such as but not necessarily a protein or polypeptide sequence of the same type of plant. In other embodiments the recombinant nutritive protein is not a plant protein or a derivative or mutein thereof.

In some embodiments the recombinant nutritive protein is recovered or partially recovered from the transgenic plant before it is consumed by a mammal.

H. Compositions

At least one nutritive protein disclosed herein may be combined with at least one second component to form a nutritive composition. In some embodiments the only source of amino acid in the composition is the at least one nutritive protein disclosed herein. In such embodiments the amino acid composition of the composition will be the same as the amino acid composition of the at least one nutritive protein disclosed herein. In some embodiments the composition comprises at least one nutritive protein disclosed herein and at least one second protein. In some embodiments the at least one second protein is a second nutritive protein disclosed herein, while in other embodiments the at least one second protein is not a nutritive protein disclosed herein. In some embodiments the composition comprises 1, 2, 3, 4, 5, 6, 7, 8, 9, 10, 11, 12, 13, 14, 15, 16, 17, 18, 19, 20 or more nutritive proteins disclosed herein. In some embodiments the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein. In some embodiments the composition comprises 1, 2, 3, 4, 5, 6, 7, 8, 9, 10, 11, 12, 13, 14, 15, 16, 17, 18, 19, 20 or more nutritive proteins and the composition comprises 0, 1, 2, 3, 4, 5, 6, 7, 8, 9, 10, 11, 12, 13, 14, 15, 16, 17, 18, 19, 20 or more proteins that are not nutritive proteins disclosed herein.

In some embodiments the nutritive composition as described in the preceding paragraph, further comprises at least one of at least one polypeptide, at least one peptide, and at least one free amino acid. In some embodiments the nutritive composition comprises at least one polypeptide and at least one peptide. In some embodiments the nutritive composition comprises at least one polypeptide and at least one free amino acid. In some embodiments the nutritive composition comprises at least one peptide and at least one free amino acid. In some embodiments the at least one polypeptide, at least one peptide, and/or at least one free amino acid comprises amino acids selected from 1) branch chain amino acids, 2) leucine, and 3) essential amino acids. In some embodiments the at least one polypeptide, at least one peptide, and/or at least one free amino acid consists of amino acids selected from 1) branch chain amino acids, 2) leucine, and 3) essential amino acids. In some embodiments, the nutritive composition comprises at least one modified amino acid or a non-standard amino acid. Modified amino acids include amino acids that have modifications to one or more of the carboxy terminus, amino terminus, and/or side chain. Non-standard amino acids may be selected from those that are formed by post-translational modification of proteins, for example, carboxylated glutamate, hydroxyproline, or hypusine. Other non-standard amino acids are not found in proteins. Examples include lanthionine, 2-aminoisobutyric acid, dehydroalanine, gamma-aminobutyric acid, ornithine and citrulline. In some embodiments, the nutritive composition comprises one or more D-amino acids. In some embodiments, the nutritive composition comprises one or more L-amino acids. In some embodiments, the nutritive composition comprises a mixture of one or more D-amino acids and one or more L-amino acids.

By adding at least one of a polypeptide, a peptide, and a free amino acid to a nutritive composition the proportion of at least one of branch chain amino acids, leucine, and essential amino acids, to total amino acid, present in the composition can be increased.

In some embodiments the composition comprises at least one carbohydrate. A "carbohydrate" refers to a sugar or polymer of sugars. The terms "saccharide," "polysaccharide," "carbohydrate," and "oligosaccharide" may be used interchangeably. Most carbohydrates are aldehydes or ketones with many hydroxyl groups, usually one on each carbon atom of the molecule. Carbohydrates generally have the molecular formula $C_nH_2O_n$. A carbohydrate may be a monosaccharide, a disaccharide, trisaccharide, oligosaccharide, or polysaccharide. The most basic carbohydrate is a monosaccharide, such as glucose, sucrose, galactose, mannose, ribose, arabinose, xylose, and fructose. Disaccharides are two joined monosaccharides. Exemplary disaccharides include sucrose, maltose, cellobiose, and lactose. Typically, an oligosaccharide includes between three and six monosaccharide units (e.g., raffinose, stachyose), and polysaccharides include six or more monosaccharide units. Exemplary polysaccharides include starch, glycogen, and cellulose. Carbohydrates may contain modified saccharide units such as 2'-deoxyribose wherein a hydroxyl group is removed, 2'-fluororibose wherein a hydroxyl group is replace with a fluorine, or N-acetylglucosamine, a nitrogen-containing form of glucose (e.g., 2'-fluororibose, deoxyribose, and hexose). Carbohydrates may exist in many different forms, for example, conformers, cyclic forms, acyclic forms, stereoisomers, tautomers, anomers, and isomers.

In some embodiments the composition comprises at least one lipid. As used herein a "lipid" includes fats, oils, triglycerides, cholesterol, phospholipids, fatty acids in any form including free fatty acids. Fats, oils and fatty acids may be saturated, unsaturated (cis or trans) or partially unsaturated (cis or trans). In some embodiments the lipid comprises at least one fatty acid selected from lauric acid (12:0), myristic acid (14:0), palmitic acid (16:0), palmitoleic acid (16:1), margaric acid (17:0), heptadecenoic acid (17:1), stearic acid (18:0), oleic acid (18:1), linoleic acid (18:2), linolenic acid (18:3), octadecatetraenoic acid (18:4), arachidic acid (20:0), eicosenoic acid (20:1), eicosadienoic acid (20:2), eicosatetraenoic acid (20:4), eicosapentaenoic acid (20:5) (EPA), docosanoic acid (22:0), docosenoic acid (22:1), docosapentaenoic acid (22:5), docosahexaenoic acid (22:6) (DHA), and tetracosanoic acid (24:0). In some embodiments the composition comprises at least one modified lipid, for example a lipid that has been modified by cooking.

In some embodiments the composition comprises at least one supplemental mineral or mineral source. Examples of minerals include, without limitation: chloride, sodium, calcium, iron, chromium, copper, iodine, zinc, magnesium, manganese, molybdenum, phosphorus, potassium, and selenium. Suitable forms of any of the foregoing minerals include soluble mineral salts, slightly soluble mineral salts, insoluble mineral salts, chelated minerals, mineral complexes, non-reactive minerals such as carbonyl minerals, and reduced minerals, and combinations thereof.

In some embodiments the composition comprises at least one supplemental vitamin. The at least one vitamin can be fat-soluble or water soluble vitamins. Suitable vitamins include but are not limited to vitamin C, vitamin A, vitamin E, vitamin B 12, vitamin K, riboflavin, niacin, vitamin D, vitamin B6, folic acid, pyridoxine, thiamine, pantothenic acid, and biotin. Suitable forms of any of the foregoing are salts of the vitamin, derivatives of the vitamin, compounds having the same or similar activity of the vitamin, and metabolites of the vitamin.

In some embodiments the composition comprises at least one organism. Suitable examples are well known in the art and include probiotics (e.g., species of *Lactobacillus* or *Bifidobacterium*), *spirulina*, *chlorella*, and *porphyra*.

In some embodiments the composition comprises at least one dietary supplement. Suitable examples are well known in the art and include herbs, botanicals, and certain hormones. Non limiting examples include ginko, gensing, and melatonin.

In some embodiments the composition comprises an excipient. Non-limiting examples of suitable excipients include a buffering agent, a preservative, a stabilizer, a binder, a compaction agent, a lubricant, a dispersion enhancer, a disintegration agent, a flavoring agent, a sweetener, a coloring agent.

In some embodiments the excipient is a buffering agent. Non-limiting examples of suitable buffering agents include sodium citrate, magnesium carbonate, magnesium bicarbonate, calcium carbonate, and calcium bicarbonate.

In some embodiments the excipient comprises a preservative. Non-limiting examples of suitable preservatives include antioxidants, such as alpha-tocopherol and ascorbate, and antimicrobials, such as parabens, chlorobutanol, and phenol.

In some embodiments the composition comprises a binder as an excipient. Non-limiting examples of suitable binders include starches, pregelatinized starches, gelatin, polyvinylpyrrolidone, cellulose, methylcellulose, sodium carboxymethylcellulose, ethylcellulose, polyacrylamides, polyvinyloxoazolidone, polyvinylalcohols, $C_{12}$-$C_{18}$ fatty acid alcohol, polyethylene glycol, polyols, saccharides, oligosaccharides, and combinations thereof.

In some embodiments the composition comprises a lubricant as an excipient. Non-limiting examples of suitable lubricants include magnesium stearate, calcium stearate, zinc stearate, hydrogenated vegetable oils, sterotex, polyoxyethylene monostearate, talc, polyethyleneglycol, sodium benzoate, sodium lauryl sulfate, magnesium lauryl sulfate, and light mineral oil.

In some embodiments the composition comprises a dispersion enhancer as an excipient. Non-limiting examples of suitable dispersants include starch, alginic acid, polyvinylpyrrolidones, guar gum, kaolin, bentonite, purified wood cellulose, sodium starch glycolate, isoamorphous silicate, and microcrystalline cellulose as high HLB emulsifier surfactants.

In some embodiments the composition comprises a disintegrant as an excipient. In some embodiments the disintegrant is a non-effervescent disintegrant. Non-limiting examples of suitable non-effervescent disintegrants include starches such as corn starch, potato starch, pregelatinized and modified starches thereof, sweeteners, clays, such as bentonite, microcrystalline cellulose, alginates, sodium starch glycolate, gums such as agar, guar, locust bean, karaya, pecitin, and tragacanth. In some embodiments the disintegrant is an effervescent disintegrant. Non-limiting examples of suitable effervescent disintegrants include sodium bicarbonate in combination with citric acid, and sodium bicarbonate in combination with tartaric acid.

In some embodiments the excipient comprises a flavoring agent. Flavoring agents incorporated into the outer layer can be chosen from synthetic flavor oils and flavoring aromatics; natural oils; extracts from plants, leaves, flowers, and fruits; and combinations thereof. In some embodiments the flavoring agent is selected from cinnamon oils; oil of wintergreen; peppermint oils; clover oil; hay oil; anise oil; eucalyptus; vanilla; citrus oil such as lemon oil, orange oil, grape and grapefruit oil; and fruit essences including apple, peach, pear, strawberry, raspberry, cherry, plum, pineapple, and apricot.

In some embodiments the excipient comprises a sweetener. Non-limiting examples of suitable sweeteners include glucose (corn syrup), dextrose, invert sugar, fructose, and mixtures thereof (when not used as a carrier); saccharin and its various salts such as the sodium salt; dipeptide sweeteners such as aspartame; dihydrochalcone compounds, glycyrrhizin; Stevia Rebaudiana (Stevioside); chloro derivatives of sucrose such as sucralose; and sugar alcohols such as sorbitol, mannitol, sylitol, and the like. Also contemplated are hydrogenated starch hydrolysates and the synthetic sweetener 3,6-dihydro-6-methyl-1,2,3-oxathiazin-4-one-2,2-dioxide, particularly the potassium salt (acesulfame-K), and sodium and calcium salts thereof.

In some embodiments the composition comprises a coloring agent. Non-limiting examples of suitable color agents include food, drug and cosmetic colors (FD&C), drug and cosmetic colors (D&C), and external drug and cosmetic colors (Ext. D&C). The coloring agents can be used as dyes or their corresponding lakes.

The weight fraction of the excipient or combination of excipients in the formulation is usually about 50% or less, about 45% or less, about 40% or less, about 35% or less, about 30% or less, about 25% or less, about 20% or less, about 15% or less, about 10% or less, about 5% or less, about 2% or less, or about 1% or less of the total weight of the amino acids in the composition.

The nutritive proteins and nutritive compositions disclosed herein can be formulated into a variety of forms and administered by a number of different means. The compositions can be administered orally, rectally, or parenterally, in formulations containing conventionally acceptable carriers, adjuvants, and vehicles as desired. The term "parenteral" as used herein includes subcutaneous, intravenous, intramuscular, or intrasternal injection and infusion techniques. In an exemplary embodiment, the nutritive protein or composition is administered orally.

Solid dosage forms for oral administration include capsules, tablets, caplets, pills, troches, lozenges, powders, and granules. A capsule typically comprises a core material comprising a nutritive protein or composition and a shell wall that encapsulates the core material. In some embodiments the core material comprises at least one of a solid, a liquid, and an emulsion. In some embodiments the shell wall material comprises at least one of a soft gelatin, a hard gelatin, and a polymer. Suitable polymers include, but are not limited to: cellulosic polymers such as hydroxypropyl cellulose, hydroxyethyl cellulose, hydroxypropyl methyl cellulose (HPMC), methyl cellulose, ethyl cellulose, cellulose acetate, cellulose acetate phthalate, cellulose acetate trimellitate, hydroxypropylmethyl cellulose phthalate, hydroxypropylmethyl cellulose succinate and carboxymethylcellulose sodium; acrylic acid polymers and copolymers, such as those formed from acrylic acid, methacrylic acid, methyl acrylate, ammonio methylacrylate, ethyl acrylate, methyl methacrylate and/or ethyl methacrylate (e.g., those copolymers sold under the trade name "Eudragit"); vinyl polymers and copolymers such as polyvinyl pyrrolidone, polyvinyl acetate, polyvinylacetate phthalate, vinylacetate crotonic acid copolymer, and ethylene-vinyl acetate copolymers; and shellac (purified lac). In some embodiments at least one polymer functions as taste-masking agents.

Tablets, pills, and the like can be compressed, multiply compressed, multiply layered, and/or coated. The coating can be single or multiple. In one embodiment, the coating material comprises at least one of a saccharide, a polysaccharide, and glycoproteins extracted from at least one of a plant, a fungus, and a microbe. Non-limiting examples include corn starch, wheat starch, potato starch, tapioca starch, cellulose, hemicellulose, dextrans, maltodextrin, cyclodextrins, inulins, pectin, mannans, gum arabic, locust bean gum, mesquite gum, guar gum, gum karaya, gum ghatti, tragacanth gum, funori, carrageenans, agar, alginates, chitosans, or gellan gum. In some embodiments the coating material comprises a protein. In some embodiments the coating material comprises at least one of a fat and an oil. In some embodiments the at least one of a fat and an oil is high temperature melting. In some embodiments the at least one of a fat and an oil is hydrogenated or partially hydrogenated. In some embodiments the at least one of a fat and an oil is derived from a plant. In some embodiments the at least one of a fat and an oil comprises at least one of glycerides, free fatty acids, and fatty acid esters. In some embodiments the coating material comprises at least one edible wax. The edible wax can be derived from animals, insects, or plants. Non-limiting examples include beeswax, lanolin, bayberry wax, carnauba wax, and rice bran wax. Tablets and pills can additionally be prepared with enteric coatings.

Alternatively, powders or granules embodying the nutritive proteins and nutritive compositions disclosed herein can be incorporated into a food product. In some embodiments the food product is be a drink for oral administration. Non-limiting examples of a suitable drink include fruit juice, a fruit drink, an artificially flavored drink, an artificially sweetened drink, a carbonated beverage, a sports drink, a liquid diary product, a shake, an alcoholic beverage, a caffeinated beverage, infant formula and so forth. Other suitable means for oral administration include aqueous and nonaqueous solutions, creams, pastes, emulsions, suspensions and slurries, of which may optionally also contain at least one of suitable solvents, preservatives, emulsifying agents, suspending agents, diluents, sweeteners, coloring agents, and flavoring agents.

In some embodiments the food product is a solid foodstuff. Suitable examples of a solid foodstuff include without limitation a food bar, a snack bar, a cookie, a brownie, a muffin, a cracker, a biscuit, a cream or paste, an ice cream bar, a frozen yogurt bar, and the like.

In some embodiments, the nutritive proteins and nutritive compositions disclosed herein are incorporated into a therapeutic food. In some embodiments, the therapeutic food is a ready-to-use food that optionally contains some or all essential macronutrients and micronutrients. In some embodiments, the nutritive proteins and nutritive compositions disclosed herein are incorporated into a supplementary food that is designed to be blended into an existing meal. In some embodiments, the supplemental food contains some or all essential macronutrients and micronutrients. In some embodiments, the nutritive proteins and nutritive compositions disclosed herein are blended with or added to an existing food to fortify the food's protein nutrition. Examples include food staples (grain, salt, sugar, cooking oil, margarine), beverages (coffee, tea, soda, beer, liquor, sports drinks), snacks, sweets and other foods.

The compositions disclosed herein can be utilized in methods to increase at least one of muscle mass, strength and physical function, thermogenesis, metabolic expenditure, satiety, mitochondrial biogenesis, weight or fat loss, and lean body composition for example.

I. Methods of Use

In some embodiments the nutritive proteins and nutritive compositions disclosed herein are administered to a patient or a user (sometimes collectively referred to as a "subject"). As used herein "administer" and "administration" encompasses embodiments in which one person directs another to consume a nutritive protein or nutritive composition in a certain manner and/or for a certain purpose, and also situations in which a user uses a nutritive protein or nutritive composition in a certain manner and/or for a certain purpose independently of or in variance to any instructions received from a second person. Non-limiting examples of embodiments in which one person directs another to consume a nutritive protein or nutritive composition in a certain manner and/or for a certain purpose include when a physician prescribes a course of conduct and/or treatment to a patient, when a trainer advises a user (such as an athlete) to follow a particular course of conduct and/or treatment, and when a manufacturer, distributer, or marketer recommends conditions of use to an end user, for example through advertisements or labeling on packaging or on other materials provided in association with the sale or marketing of a product.

In some embodiments the nutritive proteins or nutritive compositions are provided in a dosage form. In some embodiments the dosage form is designed for administration of at least one nutritive protein disclosed herein, wherein the total amount of nutritive protein administered is selected from 0.1 g to 1 g, 1 g to 5 g, from 2 g to 10 g, from 5 g to 15 g, from 10 g to 20 g, from 15 g to 25 g, from 20 g to 40 g, from 25-50 g, and from 30-60 g. In some embodiments the dosage form is designed for administration of at least one nutritive protein disclosed herein, wherein the total amount of nutritive protein administered is selected from about 0.1 g, 0.1 g-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the dosage form is designed for administration of at least one nutritive protein disclosed herein, wherein the total amount of essential amino acids administered is selected from 0.1 g to 1 g, from 1 g to 5 g, from 2 g to 10 g, from 5 g to 15 g, from 10 g to 20 g, and from 1-30 g. In some embodiments the dosage form is designed for administration of at least one nutritive protein disclosed herein, wherein the total amount of nutritive protein administered is selected from about 0.1 g, 0.1-1 g, 1 g, 2 g, 3 g, 4 g, 5 g, 6 g, 7 g, 8 g, 9 g, 10 g, 15 g, 20 g, 25 g, 30 g, 35 g, 40 g, 45 g, 50 g, 55 g, 60 g, 65 g, 70 g, 75 g, 80 g, 85 g, 90 g, 95 g, and 100 g.

In some embodiments the nutritive protein or nutritive composition is consumed at a rate of from 0.1 g to 1 g a day, 1 g to 5 g a day, from 2 g to 10 g a day, from 5 g to 15 g a day, from 10 g to 20 g a day, from 15 g to 30 g a day, from 20 g to 40 g a day, from 25 g to 50 g a day, from 40 g to 80 g a day, from 50 g to 100 g a day, or more.

In some embodiments, of the total protein intake by the subject, at least 5%, at least 10%, at least 15%, at least 20%, at least 25%, at least 30%, at least 35%, at least 40%, at least 45%, at least 50%, at least 55%, at least 60%, at least 65%, at least 70%, at least 75%, at least 80%, at least 85%, at least 90%, at least 95%, or about 100% of the total protein intake by the subject over a dietary period is made up of at least one nutritive protein according to this disclosure. In some embodiments, of the total protein intake by the subject, from 5% to 100% of the total protein intake by the subject, from 5% to 90% of the total protein intake by the subject, from 5% to 80% of the total protein intake by the subject, from 5% to 70% of the total protein intake by the subject, from 5% to 60% of the total protein intake by the subject, from 5% to 50% of the total protein intake by the subject, from 5% to 40% of the total protein intake by the subject, from 5% to 30% of the total protein intake by the subject, from 5% to 20% of the total protein intake by the subject, from 5% to 10% of the total protein intake by the subject, from 10% to 100% of the total protein intake by the subject, from 10% to 100% of the total protein intake by the subject, from 20% to 100% of the total protein intake by the subject, from 30% to 100% of the total protein intake by the subject, from 40% to 100% of the total protein intake by the subject, from 50% to 100% of the total protein intake by the subject, from 60% to 100% of the total protein intake by the subject, from 70% to 100% of the total protein intake by the subject, from 80% to 100% of the total protein intake by the subject, or from 90% to 100% of the total protein intake by the subject, over a dietary period, is made up of at least one nutritive protein according to this disclosure. In some embodiments the at least one nutritive protein of this disclosure accounts for at least 5%, at least 10%, at least 15%, at least 20%, at least 25%, at least 30%, at least 35%, at least 40%, at least 45%, or at least 50% of the subject's calorie intake over a dietary period.

In some embodiments the at least one nutritive protein according to this disclosure comprises at least 2 nutritive proteins of this disclosure, at least 3 nutritive proteins of this disclosure, at least 4 nutritive proteins of this disclosure, at least 5 nutritive proteins of this disclosure, at least 6 nutritive proteins of this disclosure, at least 7 nutritive proteins of this disclosure, at least 8 nutritive proteins of this disclosure, at least 9 nutritive proteins of this disclosure, at least 10 nutritive proteins of this disclosure, or more.

In some embodiments the dietary period is 1 meal, 2 meals, 3 meals, at least 1 day, at least 2 days, at least 3 days, at least 4 days, at least 5 days, at least 6 days, at least 1 week, at least 2 weeks, at least 3 weeks, at least 4 weeks, at least 1 month, at least 2 months, at least 3 months, at least 4 months, at least 5 months, at least 6 months, or at least 1 year. In some embodiments the dietary period is from 1 day to 1 week, from 1 week to 4 weeks, from 1 month, to 3 months, from 3 months to 6 months, or from 6 months to 1 year.

Clinical studies provide evidence that protein prevents muscle loss due to aging or bed rest. In particular, studies have shown that protein supplementation increases muscle fractional synthetic rate (FSR) during prolonged bed rest, maintains leg mass and strength during prolonged bed rest, increases lean body mass, improves functional measures of gait and balance, and may serve as a viable intervention for individuals at risk of sarcopenia due to immobility or prolonged bed rest. (See, e.g., Paddon-Jones D, et al. *J Clin Endocrinol Metab* 2004, 89:4351-4358; Ferrando, A et al. *Clinical Nutrition* 2009 1-6; Katsanos C et al. *Am J Physiol Endocrinol Metab.* 2006, 291: 381-387).

Studies on increasing muscle protein anabolism in athletes have shown that protein provided following exercise promotes muscle hypertrophy to a greater extent than that achieved by exercise alone. It has also been shown that protein provided following exercise supports protein synthesis without any increase in protein breakdown, resulting in a net positive protein balance and muscle mass accretion. While muscle protein synthesis appears to respond in a dose-response fashion to essential amino acid supplementation, not all proteins are equal in building muscle. For example, the amino acid leucine is an important factor in stimulating muscle protein synthesis. (See, e.g., Borscheim E et al. *Am J Physiol Endocrinol Metab* 2002, 283: E648-E657; Borsheim E et al. *Clin Nutr.* 2008, 27: 189-95; Esmarck B et al *J Physiol* 2001, 535: 301-311; Moore D et al. *Am J Clin Nutr* 2009, 89: 161-8).

In another aspect this disclosure provides methods of maintaining or increasing at least one of muscle mass, muscle strength, and functional performance in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of maintaining or achieving a desirable body mass index in a subject. In some embodiments the methods comprise providing to the subject a sufficient amount of a nutritive protein of this disclosure, a nutritive composition of this disclosure, or a nutritive composition made by a method of this disclosure. In some embodiments the subject is at least one of elderly, critically-medically ill, and suffering from protein-energy malnutrition. In some embodiments the sufficient amount of a nutritive protein of this disclosure, a nutritive composition of this disclosure, or a nutritive composition made by a method of this disclosure is consumed by the subject in coordination with performance of exercise. In some embodiments the nutritive protein of this disclosure, nutritive composition of this disclosure, or nutritive composition made by a method of this disclosure is consumed by the subject by an oral, enteral, or parenteral route.

In another aspect this disclosure provides methods of providing protein to a subject with protein-energy malnutrition. In some embodiments the methods comprise providing to the subject a sufficient amount of a nutritive protein of this disclosure, a nutritive composition of this disclosure, or a nutritive composition made by a method of this disclosure. In some embodiments the nutritive protein of this disclosure, nutritive composition of this disclosure, or nutritive composition made by a method of this disclosure is consumed by the subject by an oral, enteral, or parenteral route.

The need for essential amino acid supplementation has been suggested in cancer patients and other patients suffering from cachexia. Dietary studies in mice have shown survival and functional benefits to cachectic cancer-bearing mice through dietary intervention with essential amino acids. Beyond cancer, essential amino acid supplementation has also shown benefits, such as improved muscle function and muscle gain, in patients suffering from other diseases who have difficulty exercising and therefore suffer from muscular deterioration, such as chronic obstructive pulmonary disease, chronic heart failure, HIV, and other disease states.

Studies have shown that specific amino acids have advantages in managing cachexia. A relatively high content of BCAAs and Leu in diets are thought to have a positive effect in cachexia by promoting total protein synthesis by signaling an increase in translation, enhancing insulin release, and inhibiting protein degradation. Thus, consuming increased dietary BCAAs in general and/or Leu in particular will contribute positively to reduce or reverse the effects of cachexia. Because nitrogen balance is important in countering the underlying cause of cachexia it is thought that consuming increased dietary glutamine and/or arginine will contribute positively to reduce or reverse the effects of cachexia. (See, e.g., Op den Kamp C, Langen R, Haegens A, Schols A. "Muscle atrophy in cachexia: can dietary protein tip the balance?" *Current Opinion in Clinical Nutrition and Metabolic Care* 2009, 12:611-616; Poon R T-P, Yu W-C, Fan S-T, et al. "Long-term oral branched chain amino acids in patients undergoing chemoembolization for hepatocellular carcinoma: a randomized trial." *Aliment Pharmacol Ther* 2004; 19:779-788; Tayek J A, Bistrian B R, Hehir D J, Martin R, Moldawer L L, Blackburn G L, "Improved protein kinetics and albumin synthesis by branched chain amino acid-enriched total parenteral nutrition in cancer cachexia." *Cancer,* 1986; 58:147-57; Xi P, Jiang Z, Zheng C, Lin Y, Wu G "Regulation of protein metabolism by glutamine: implications for nutrition and health." *Front Biosci.* 2011 Jan. 1; 16:578-97).

Accordingly, also provided herein are methods of treating cachexia in a subject. In some embodiments a sufficient amount of a nutritive protein of this disclosure, a nutritive composition of this disclosure, or a nutritive composition made by a method of this disclosure for a subject with cachexia is an amount such that the amount of protein of this disclosure ingested by the person meets or exceeds the metabolic needs (which are often elevated). A protein intake of 1.5 g/kg of body weight per day or 15-20% of total caloric intake appears to be an appropriate target for persons with cachexia. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments the subject suffers from a disease that makes exercise difficult and therefore causes muscular deterioration, such as chronic obstructive pulmonary disease, chronic heart failure, HIV, cancer, and other disease states. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Sarcopenia is the degenerative loss of skeletal muscle mass (typically 0.5-1% loss per year after the age of 25), quality, and strength associated with aging. Sarcopenia is a component of the frailty syndrome. The European Working Group on Sarcopenia in Older People (EWGSOP) has developed a practical clinical definition and consensus diagnostic criteria for age-related sarcopenia. For the diagnosis of sarcopenia, the working group has proposed using the presence of both low muscle mass and low muscle function (strength or performance). Sarcopenia is characterized first by a muscle atrophy (a decrease in the size of the muscle), along with a reduction in muscle tissue "quality," caused by such factors as replacement of muscle fibres with fat, an increase in fibrosis, changes in muscle metabolism, oxidative stress, and degeneration of the neuromuscular junction. Combined, these changes lead to progressive loss of muscle function and eventually to frailty. Frailty is a common geriatric syndrome that embodies an elevated risk of catastrophic declines in health and function among older adults. Contributors to frailty can include sarcopenia, osteoporosis, and muscle weakness. Muscle weakness, also known as muscle fatigue, (or "lack of strength") refers to the inability to exert force with one's skeletal muscles. Weakness often follows muscle atrophy and a decrease in activity, such as after a long bout of bedrest as a result of an illness. There is also a gradual onset of muscle weakness as a result of sarcopenia.

The nutritive proteins of this disclosure are useful for treating sarcopenia or frailty once it develops in a subject or for preventing the onset of sarcopenia or frailty in a subject who is a member of an at risk groups. In some embodiments all of the protein consumed by the subject is a nutritive protein according to this disclosure. In some embodiments nutritive protein according to this disclosure is combined with other sources of protein and/or free amino acids to provide the total protein intake of the subject. In some embodiments the subject is at least one of elderly, critically-medically ill, and suffering from protein-energy malnutrition. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to this disclosure, the nutritive composition according to disclosure, or the nutritive composition made by a method according to disclosure is consumed by the subject by an oral, enteral, or parenteral route.

Obesity is a multifactorial disorder associated with a host of comorbidities including hypertension, type 2 diabetes, dyslipidemia, coronary heart disease, stroke, cancer (eg, endometrial, breast, and colon), osteoarthritis, sleep apnea, and respiratory problems. The incidence of obesity, defined as a body mass index >30 kg/m$^2$, has increased dramatically in the United States, from 15% (1976-1980) to 33% (2003-2004), and it continues to grow. Although the mechanisms contributing to obesity are complex and involve the interplay of behavioral components with hormonal, genetic, and metabolic processes, obesity is largely viewed as a lifestyle-dependent condition with 2 primary causes: excessive energy intake and insufficient physical activity. With respect to energy intake, there is evidence that modestly increasing the proportion of protein in the diet, while controlling total energy intake, may improve body composition, facilitate fat loss, and improve body weight maintenance after weight loss. Positive outcomes associated with increased dietary protein are thought to be due primarily to lower energy intake associated with increased satiety, reduced energy efficiency and/or increased thermogenesis, positive effects on body composition (specifically lean muscle mass), and enhanced glycemic control.

Dietary proteins are more effective in increasing post-prandial energy expenditure than isocaloric intakes of carbohydrates or fat (see, e.g., Dauncey M, Bingham S. "Dependence of 24 h energy expenditure in man on composition of the nutrient intake." *Br J Nutr* 1983, 50:1-13; Karst H et al. "Diet-induced thermogenesis in man: thermic effects of single proteins, carbohydrates and fats depending on their energy amount." *Ann Nutr Metab.* 1984, 28: 245-52; Tappy L et al "Thermic effect of infused amino acids in healthy humans and in subjects with insulin resistance." *Am J Clin Nutr* 1993, 57 (6): 912-6). This property along with other properties (satiety induction; preservation of lean body mass) make protein an attractive component of diets directed at weight management. The increase in energy expenditure caused by such diets may in part be due to the fact that the energy cost of digesting and metabolizing protein is higher than for other calorie sources. Protein turnover, including protein synthesis, is an energy consuming process. In addition, high protein diets may also up-regulate uncoupling protein in liver and brown adipose, which is positively correlated with increases in energy expenditure. It has been theorized that different proteins may have unique effects on energy expenditure.

Studies suggest that ingestion of protein, particularly proteins with high EAA and/or BCAA content, leads to distinct effects on thermogenesis and energy expenditure (see, e.g., Mikkelsen P. et al. "Effect of fat-reduced diets on 24 h energy expenditure: comparisons between animal protein, vegetable protein and carbohydrate." *Am J Clin Nutr* 2000, 72:1135-41; Acheson K. et al. "Protein choices targeting thermogenesis and metabolism." *Am J Clin Nutr* 2011, 93:525-34; Alfenas R. et al. "Effects of protein quality on appetite and energy metabolism in normal weight subjects" *Arg Bras Endocrinol Metabol* 2010, 54 (1): 45-51; Lorenzen J. et al. "The effect of milk proteins on appetite regulation and diet-induced thermogenesis." *J Clin Nutr* 2012 66 (5): 622-7). Additionally, L-tyrosine has been identified as an amino acid that plays a role in thermogenesis (see, e.g., Belza A. et al. "The beta-adrenergic antagonist propranolol partly abolishes thermogenic response to bioactive food ingredients." *Metabolism* 2009, 58 (8):1137-44). Further studies suggest that Leucine and Arginine supplementation appear to alter energy metabolism by directing substrate to lean body mass rather than adipose tissue (Dulloo A. "The search for compounds that stimulate thermogenesis in obesity management: from pharmaceuticals to functional food ingredients." *Obes Rev* 2011 12: 866-83).

Collectively the literature suggests that different protein types leads to distinct effects on thermogenesis. Because proteins or peptides rich in EAAs, BCAA, and/or at least one of Tyr, Arg, and Leu are believed to have a stimulatory effect on thermogenesis, and because stimulation of thermogenesis is believed to lead to positive effects on weight management, this disclosure also provides products and methods useful to stimulation thermogenesis and/or to bring about positive effects on weight management in general.

More particularly, this disclosure provides methods of increasing thermogenesis in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

At the basic level, the reason for the development of an overweight condition is due to an imbalance between energy intake and energy expenditure. Attempts to reduce food at any particular occasion (satiation) and across eating occasions (satiety) have been a major focus of recent research. Reduced caloric intake as a consequence of feeling satisfied during a meal and feeling full after a meal results from a complex interaction of internal and external signals. Various nutritional studies have demonstrated that variation in food properties such as energy density, content, texture and taste influence both satiation and satiety.

There are three macronutrients that deliver energy: fat, carbohydrates and proteins. A gram of protein or carbohydrate provides 4 calories while a gram of fat 9 calories. Protein generally increases satiety to a greater extent than carbohydrates or fat and therefore may facilitate a reduction in calorie intake. However, there is considerable evidence that indicates the type of protein matters in inducing satiety (see, e.g., W. L. Hall, et al. "Casein and whey exert different effects on plasma amino acid profiles, gastrointestinal hormone secretion and appetite." *Br J Nutr.* 2003 February, 89(2):239-48; R. Abou-Samra, et al. "Effect of different protein sources on satiation and short-term satiety when consumed as a starter." *Nutr J.* 2011 Dec. 23, 10:139; T. Akhavan, et al. "Effect of premeal consumption of whey protein and its hydrolysate on food intake and postmeal glycemia and insulin responses in young adults." *Am J Clin Nutr.* 2010 April, 91(4):966-75, Epub 2010 Feb. 17; MA Veldhorst "Dose-dependent satiating effect of whey relative to casein or soy" *Physiol Behav.* 2009 Mar. 23, 96(4-5):675-82). Evidence indicates that protein rich in Leucine is particularly effective at inducing satiety (see, e.g., Fromentin G et al "Peripheral and central mechanisms involved in the control of food intake by dietary amino acids and proteins." *Nutr Res Rev* 2012 25: 29-39).

In some embodiments a nutritive protein of this disclosure is consumed by a subject concurrently with at least one pharmaceutical or biologic drug product. In some embodiments the beneficial effects of the nutritive protein and the at least one pharmaceutical or biologic drug product have an additive effect while in some embodiments the beneficial effects of the nutritive protein and the at least one pharmaceutical or biologic drug product have a synergistic effect. Examples of pharmaceutical or biologic drug products that can be administered with the nutritive proteins of this disclosure are well known in the art. For example, when a nutritive protein of this disclosure is used to maintain or increase at least one of muscle mass, muscle strength, and functional performance in a subject, the nutritive protein may be consumed by a subject concurrently with a therapeutic dosage regime of at least one pharmaceutical or biologic drug product indicated to maintain or increase at least one of muscle mass, muscle strength, and functional performance in a subject, such as an anabolic steroid. When a nutritive protein of this disclosure is used to maintain or achieve a desirable body mass index in a subject, the nutritive protein may be consumed by a subject concurrently with a therapeutic dosage regime of at least one pharmaceutical or biologic drug product indicated to maintain or achieve a desirable body mass index in a subject, such as orlistat, lorcaserin, sibutramine, rimonabant, metformin, exenatide, or pramlintide. When a nutritive protein of this disclosure is used to induce at least one of a satiation response and a satiety response in a subject, the nutritive protein may be consumed by a subject concurrently with a therapeutic dosage regime of at least one pharmaceutical or biologic drug product indicated to induce at least one of a satiation response and a satiety response in a subject, such as rimonabant, exenatide, or pramlintide. When a nutritive protein of this disclosure is used to treat at least one of cachexia, sarcopenia and frailty in a subject, the nutritive protein may be consumed by a subject concurrently with a therapeutic dosage regime of at least one pharmaceutical or biologic drug product indicated to treat at least one of cachexia, sarcopenia and frailty, such as omega-3 fatty acids or anabolic steroids. Because of the role of dietary protein in inducing satiation and satiety, the nutritive proteins and nutritive compositions disclosed herein can be used to induce at least one of a satiation response and a satiety response in a subject. In some embodiments the methods comprise providing to the subject a sufficient amount of a nutritive protein of this disclosure, a nutritive composition of this disclosure, or a nutritive composition made by a method of this disclosure. In some embodiments the subject is obese. In some embodiments, the nutritive protein according to disclosure, the nutritive composition according to disclosure, or the nutritive composition made by a method according to disclosure is consumed by the subject in coordination with performance of exercise. In some embodiments, the nutritive protein according to disclosure, the nutritive composition according to disclosure, or the nutritive composition made by a method according to disclosure is consumed by the subject by an oral, enteral, or parenteral route.

In some embodiments incorporating a least one nutritive protein or nutritive composition of this disclosure into the diet of a subject has at least one effect selected from inducing postprandial satiety (including by suppressing hunger), inducing thermogenesis, reducing glycemic response, positively affecting energy expenditure positively affecting lean body mass, reducing the weight gain caused by overeating, and decreasing energy intake. In some embodiments incorporating a least one nutritive protein or nutritive composition of this disclosure into the diet of a subject has at least one effect selected from increasing loss of body fat, reducing lean tissue loss, improving lipid profile, and improving glucose tolerance and insulin sensitivity in the subject.

EXAMPLES

The following examples serve to more fully describe the manner of using the invention. These examples are presented for illustrative purposes and should not serve to limit the true scope of the invention.

Example 1

Identification of Proteins Containing Ratios of Essential Amino Acids, Branch Chain Amino Acids, and Leucine Greater than or Equal to Gelatin The UniProtKB/Swiss-Prot (a collaboration between the European Bioinformatics Institute and the Swiss Institute of Bioinformatics) is a manually curated and reviewed protein database, and was used as the starting point for protein identification. Proteins from the edible species *Solanum lycopersicum, Zea mays, Oryza sativa* subsp. *Japonica, Glycine max, Ovis aries, Pisum sativum, Spinacia oleracea, Oryza sativa* subsp. *Indica, Triticum aestivum, Sus scrofa, Prunus persica, Capsicum annuum, Malus domestica, Thunnus albacares, Capra hircus, Cicer arietinum, Salmo salar, Meleagris gallopavo, Solanum tuberosum,* and *Agaricus bisporus* having greater than or equal to fifty (50) amino acids were sampled as targets for this example. This provided a set of 8,415 proteins for evaluation. The amino acid content, percentage of essential amino acids ("EAA"), the percentage of branched chain amino acids ("BCAA"), the percentage of leucine ("L"), and whether the protein contained all of the essential amino acids were calculated for each protein. The SolvScore was also calculated for each protein. In addition, the proteins were screened against a database of known allergens to determine whether any had greater than 50% global homology to a known allergen. A total of 463 proteins were identified that have a SolveScore of 20 or less and that contain greater than or equal to 19% EAA, greater than or equal to 8% BCAA, and greater than or equal to 4% Leu, and have less than 50% global homology to known allergens (SEQ ID NOS: 1 to 463). (These values were used to identify nutritive proteins of interest in this Example in order to ensure that the identified proteins have a higher content of EAA, BCAA, and Leu than gelatin). For the set of proteins the solvation score at pH 7 ("SolvScore"), aggregation score at pH 7 ("AggScore"), allergenicity (i.e., percent local homology to known allergens, as described herein), toxicity (i.e., percent homology to known toxins, as described herein), anti-nutricity (i.e., percent homology to known protease inhibitors, as described herein), and human homology (i.e., percent homology to known human proteins, as described herein) were calculated, and the total number of Cys residues ("C") were determined. The characteristics of 200 representative proteins thus identified are presented in Tables 3A and 3B.

TABLE 3A

| Seq ID No | UniProt | EAA | BCAA | L | C |
|---|---|---|---|---|---|
| 1 | P13915 | 0.38 | 0.18 | 0.09 | 2 |
| 2 | Q39817 | 0.44 | 0.16 | 0.06 | 4 |
| 3 | O82709 | 0.45 | 0.17 | 0.05 | 4 |
| 4 | P30236 | 0.49 | 0.23 | 0.12 | 1 |
| 5 | Q29092 | 0.46 | 0.19 | 0.08 | 5 |
| 6 | P19244 | 0.54 | 0.25 | 0.12 | 0 |
| 7 | Q9TV61 | 0.45 | 0.19 | 0.10 | 16 |
| 8 | Q9TV63 | 0.45 | 0.19 | 0.10 | 16 |
| 9 | P15590 | 0.34 | 0.15 | 0.06 | 8 |
| 10 | Q9TV62 | 0.45 | 0.18 | 0.10 | 16 |
| 11 | Q9SP22 | 0.44 | 0.14 | 0.05 | 2 |
| 12 | Q9SLY8 | 0.44 | 0.13 | 0.05 | 3 |
| 13 | P86412 | 0.57 | 0.22 | 0.08 | 2 |
| 14 | Q6YNX6 | 0.44 | 0.16 | 0.06 | 0 |
| 15 | P79293 | 0.44 | 0.19 | 0.11 | 14 |
| 16 | Q08275 | 0.44 | 0.20 | 0.07 | 1 |
| 17 | P02547 | 0.33 | 0.16 | 0.09 | 1 |
| 18 | Q6Z6L5 | 0.39 | 0.22 | 0.10 | 0 |
| 19 | Q0JNS6 | 0.46 | 0.17 | 0.07 | 1 |
| 20 | Q0DJV6 | 0.34 | 0.13 | 0.07 | 4 |
| 21 | Q0IUU4 | 0.43 | 0.16 | 0.09 | 3 |
| 22 | P62163 | 0.46 | 0.17 | 0.07 | 1 |
| 23 | P04353 | 0.45 | 0.17 | 0.07 | 1 |
| 24 | A2WN93 | 0.46 | 0.17 | 0.07 | 1 |
| 25 | A2WNH1 | 0.46 | 0.17 | 0.07 | 1 |
| 26 | P93087 | 0.46 | 0.17 | 0.07 | 1 |
| 27 | Q7DMN9 | 0.45 | 0.17 | 0.07 | 1 |
| 28 | P84339 | 0.45 | 0.16 | 0.07 | 0 |
| 29 | P24632 | 0.43 | 0.20 | 0.08 | 1 |
| 30 | Q5ZCK5 | 0.35 | 0.13 | 0.04 | 4 |
| 31 | Q6ES52 | 0.44 | 0.19 | 0.07 | 4 |
| 32 | P29269 | 0.47 | 0.12 | 0.06 | 1 |
| 33 | P41040 | 0.45 | 0.18 | 0.08 | 1 |
| 34 | P24631 | 0.45 | 0.21 | 0.08 | 1 |
| 35 | Q6F332 | 0.46 | 0.17 | 0.07 | 1 |
| 36 | Q0JNL7 | 0.46 | 0.17 | 0.07 | 1 |
| 37 | Q0IQB6 | 0.43 | 0.16 | 0.09 | 3 |
| 38 | A2Y609 | 0.46 | 0.17 | 0.07 | 1 |
| 39 | Q40642 | 0.41 | 0.16 | 0.06 | 2 |
| 40 | P04464 | 0.45 | 0.17 | 0.07 | 1 |
| 41 | P48976 | 0.45 | 0.17 | 0.07 | 1 |
| 42 | P27161 | 0.45 | 0.17 | 0.08 | 1 |
| 43 | Q8S1Y9 | 0.41 | 0.16 | 0.06 | 2 |
| 44 | P13868 | 0.45 | 0.16 | 0.08 | 1 |
| 45 | P10246 | 0.45 | 0.16 | 0.06 | 1 |
| 46 | P46254 | 0.43 | 0.21 | 0.11 | 0 |
| 47 | Q84MN0 | 0.45 | 0.19 | 0.09 | 1 |
| 48 | Q2R1Z5 | 0.45 | 0.16 | 0.06 | 1 |
| 49 | P02540 | 0.37 | 0.19 | 0.10 | 1 |
| 139 | P21753 | 0.52 | 0.09 | 0.05 | 0 |
| 140 | Q75ZZ6 | 0.37 | 0.13 | 0.07 | 0 |
| 141 | Q6DUB7 | 0.42 | 0.15 | 0.09 | 0 |
| 142 | Q95274 | 0.46 | 0.09 | 0.04 | 0 |
| 143 | P58272 | 0.44 | 0.19 | 0.07 | 0 |
| 144 | Q8S1Z1 | 0.44 | 0.15 | 0.08 | 0 |
| 145 | B5X4E0 | 0.42 | 0.14 | 0.06 | 2 |
| 146 | Q08655 | 0.59 | 0.13 | 0.06 | 0 |
| 147 | Q10B98 | 0.32 | 0.10 | 0.04 | 3 |
| 148 | Q6H7U2 | 0.37 | 0.13 | 0.06 | 4 |
| 149 | P46618 | 0.46 | 0.19 | 0.06 | 0 |
| 150 | P0C380 | 0.46 | 0.19 | 0.06 | 0 |
| 151 | P0C379 | 0.46 | 0.19 | 0.06 | 0 |
| 152 | P47815 | 0.41 | 0.19 | 0.07 | 3 |
| 153 | Q29361 | 0.52 | 0.21 | 0.12 | 0 |
| 154 | B5X186 | 0.41 | 0.14 | 0.05 | 2 |
| 155 | P17703 | 0.51 | 0.19 | 0.12 | 0 |
| 156 | B5DGI7 | 0.36 | 0.13 | 0.06 | 0 |
| 157 | P37219 | 0.60 | 0.12 | 0.04 | 0 |
| 158 | P0C470 | 0.51 | 0.19 | 0.11 | 0 |
| 159 | P0C469 | 0.51 | 0.19 | 0.11 | 0 |
| 160 | P69661 | 0.50 | 0.19 | 0.12 | 0 |
| 161 | P42755 | 0.31 | 0.10 | 0.06 | 0 |
| 162 | P12675 | 0.41 | 0.13 | 0.07 | 5 |
| 163 | Q6ZK48 | 0.40 | 0.13 | 0.06 | 6 |
| 164 | A2YQU8 | 0.40 | 0.13 | 0.06 | 6 |
| 165 | Q0JHZ2 | 0.42 | 0.14 | 0.05 | 6 |
| 166 | Q9M4U5 | 0.42 | 0.12 | 0.06 | 3 |
| 167 | Q8LH03 | 0.34 | 0.15 | 0.08 | 3 |
| 168 | P61268 | 0.46 | 0.21 | 0.07 | 4 |
| 169 | B5XCZ6 | 0.44 | 0.19 | 0.12 | 0 |
| 170 | P56276 | 0.37 | 0.14 | 0.04 | 5 |
| 171 | P14287 | 0.37 | 0.14 | 0.06 | 1 |
| 172 | Q9MYT8 | 0.37 | 0.21 | 0.11 | 0 |
| 173 | Q08000 | 0.28 | 0.09 | 0.05 | 0 |
| 174 | Q29307 | 0.40 | 0.13 | 0.05 | 0 |
| 175 | B5XGH3 | 0.54 | 0.24 | 0.12 | 2 |
| 176 | Q9AS36 | 0.38 | 0.15 | 0.06 | 8 |
| 177 | O97965 | 0.36 | 0.09 | 0.04 | 2 |
| 178 | Q2PMN9 | 0.48 | 0.22 | 0.09 | 0 |
| 179 | Q6Q311 | 0.51 | 0.19 | 0.10 | 1 |
| 180 | O04438 | 0.43 | 0.15 | 0.06 | 2 |
| 181 | P22701 | 0.30 | 0.09 | 0.05 | 0 |
| 182 | P83884 | 0.51 | 0.13 | 0.05 | 5 |
| 183 | P13618 | 0.42 | 0.12 | 0.06 | 0 |
| 184 | Q65WT0 | 0.42 | 0.16 | 0.07 | 11 |
| 185 | Q6K5K2 | 0.43 | 0.15 | 0.06 | 24 |
| 186 | P12026 | 0.51 | 0.16 | 0.07 | 0 |
| 187 | Q5KQI4 | 0.37 | 0.14 | 0.08 | 3 |
| 188 | P04568 | 0.27 | 0.09 | 0.05 | 0 |
| 189 | Q9XGX7 | 0.43 | 0.16 | 0.09 | 4 |
| 190 | P46291 | 0.56 | 0.22 | 0.11 | 2 |
| 191 | Q2MI43 | 0.52 | 0.24 | 0.12 | 0 |
| 192 | Q69V36 | 0.37 | 0.16 | 0.09 | 1 |
| 193 | P46517 | 0.32 | 0.10 | 0.05 | 0 |
| 194 | Q9M3I4 | 0.53 | 0.24 | 0.14 | 1 |
| 195 | P67985 | 0.49 | 0.20 | 0.08 | 1 |
| 196 | P48504 | 0.47 | 0.15 | 0.06 | 6 |

TABLE 3A-continued

| Seq ID No | UniProt | EAA | BCAA | L | C |
|---|---|---|---|---|---|
| 197 | Q94DE2 | 0.40 | 0.16 | 0.07 | 11 |
| 198 | P12151 | 0.44 | 0.22 | 0.10 | 2 |
| 199 | P0C474 | 0.44 | 0.22 | 0.10 | 2 |
| 200 | A2XAM1 | 0.46 | 0.16 | 0.06 | 7 |
| 201 | P46520 | 0.26 | 0.09 | 0.04 | 0 |
| 202 | P41101 | 0.52 | 0.19 | 0.07 | 1 |
| 203 | Q64L94 | 0.47 | 0.22 | 0.10 | 3 |
| 204 | Q10RE5 | 0.41 | 0.17 | 0.07 | 3 |
| 205 | A2XCT8 | 0.41 | 0.17 | 0.07 | 3 |
| 206 | Q7XNS7 | 0.44 | 0.19 | 0.10 | 1 |
| 207 | P49120 | 0.54 | 0.16 | 0.04 | 0 |
| 208 | Q41396 | 0.46 | 0.24 | 0.10 | 2 |
| 209 | Q2PMR3 | 0.51 | 0.19 | 0.04 | 5 |
| 210 | Q8L805 | 0.50 | 0.21 | 0.11 | 0 |
| 211 | P28520 | 0.41 | 0.17 | 0.06 | 2 |
| 212 | Q5JLY8 | 0.37 | 0.18 | 0.09 | 4 |
| 213 | O18734 | 0.34 | 0.19 | 0.13 | 1 |
| 214 | P49680 | 0.46 | 0.19 | 0.10 | 7 |
| 215 | Q8LJS2 | 0.42 | 0.14 | 0.06 | 3 |
| 216 | A7WLH8 | 0.47 | 0.17 | 0.07 | 1 |
| 217 | Q2MJV9 | 0.39 | 0.17 | 0.07 | 3 |
| 218 | A2XAM0 | 0.47 | 0.16 | 0.06 | 8 |
| 219 | A1L4T4 | 0.44 | 0.17 | 0.08 | 4 |
| 220 | A2Z7C4 | 0.44 | 0.17 | 0.08 | 4 |
| 221 | P55844 | 0.55 | 0.25 | 0.10 | 0 |
| 222 | A5YVD9 | 0.44 | 0.18 | 0.09 | 3 |
| 223 | P0CE66 | 0.47 | 0.17 | 0.06 | 8 |
| 224 | B7F6L8 | 0.47 | 0.17 | 0.06 | 8 |
| 225 | Q2VEC4 | 0.55 | 0.24 | 0.12 | 0 |
| 226 | Q943L2 | 0.53 | 0.17 | 0.04 | 0 |
| 227 | A2WWU2 | 0.53 | 0.17 | 0.04 | 0 |
| 228 | O65821 | 0.55 | 0.18 | 0.05 | 0 |
| 229 | Q2QWE9 | 0.43 | 0.13 | 0.07 | 6 |
| 230 | Q9ZQW8 | 0.30 | 0.12 | 0.04 | 7 |
| 231 | Q43694 | 0.41 | 0.15 | 0.06 | 4 |
| 232 | A2ZIW7 | 0.43 | 0.13 | 0.07 | 6 |
| 233 | P60099 | 0.43 | 0.19 | 0.08 | 3 |
| 234 | P60098 | 0.43 | 0.19 | 0.08 | 3 |
| 235 | B5XG43 | 0.47 | 0.16 | 0.06 | 4 |
| 236 | Q6ZBP3 | 0.51 | 0.15 | 0.05 | 0 |
| 237 | A2YWI3 | 0.51 | 0.15 | 0.05 | 0 |
| 238 | O49118 | 0.52 | 0.17 | 0.05 | 0 |
| 239 | P27723 | 0.44 | 0.22 | 0.09 | 2 |
| 240 | P25461 | 0.47 | 0.16 | 0.04 | 4 |
| 241 | O04433 | 0.51 | 0.14 | 0.07 | 3 |
| 242 | Q7XEJ5 | 0.45 | 0.20 | 0.09 | 3 |
| 243 | P62272 | 0.50 | 0.23 | 0.09 | 0 |
| 244 | A5JST6 | 0.50 | 0.23 | 0.09 | 0 |
| 245 | P08698 | 0.41 | 0.23 | 0.07 | 0 |
| 246 | A5A777 | 0.46 | 0.15 | 0.08 | 3 |
| 247 | P62901 | 0.49 | 0.19 | 0.05 | 0 |
| 248 | B5XG19 | 0.40 | 0.14 | 0.07 | 0 |
| 249 | A1Y2B7 | 0.43 | 0.14 | 0.07 | 4 |
| 250 | Q2QLT8 | 0.43 | 0.17 | 0.05 | 4 |
| 251 | P46605 | 0.37 | 0.15 | 0.06 | 15 |
| 252 | Q8LNU5 | 0.47 | 0.19 | 0.09 | 14 |
| 253 | O24473 | 0.45 | 0.18 | 0.08 | 5 |
| 254 | P68211 | 0.41 | 0.12 | 0.08 | 0 |
| 255 | Q05462 | 0.62 | 0.21 | 0.09 | 1 |
| 256 | B5XBI1 | 0.37 | 0.20 | 0.10 | 0 |
| 257 | Q43216 | 0.55 | 0.17 | 0.05 | 0 |
| 258 | O65818 | 0.55 | 0.17 | 0.05 | 0 |
| 259 | B5SNZ6 | 0.39 | 0.14 | 0.05 | 4 |
| 260 | P62262 | 0.41 | 0.20 | 0.10 | 3 |
| 261 | Q8LJU5 | 0.47 | 0.22 | 0.08 | 1 |
| 262 | Q5FZP5 | 0.36 | 0.18 | 0.11 | 0 |
| 263 | Q0JGY1 | 0.42 | 0.16 | 0.08 | 1 |
| 264 | Q29561 | 0.44 | 0.20 | 0.07 | 4 |
| 265 | Q8H2P8 | 0.42 | 0.14 | 0.06 | 4 |
| 266 | P55871 | 0.42 | 0.18 | 0.08 | 6 |
| 267 | P02632 | 0.45 | 0.20 | 0.13 | 0 |
| 268 | Q40703 | 0.47 | 0.19 | 0.09 | 2 |
| 269 | B5X7E4 | 0.37 | 0.17 | 0.08 | 1 |
| 270 | Q94IB1 | 0.36 | 0.13 | 0.07 | 6 |
| 271 | Q6B7M7 | 0.51 | 0.22 | 0.09 | 5 |
| 272 | P10668 | 0.51 | 0.22 | 0.09 | 5 |
| 273 | P30755 | 0.53 | 0.16 | 0.05 | 0 |
| 274 | A2WXX3 | 0.41 | 0.16 | 0.08 | 1 |
| 275 | A1XQU5 | 0.53 | 0.18 | 0.05 | 0 |
| 276 | Q08069 | 0.44 | 0.16 | 0.07 | 2 |
| 277 | Q712U6 | 0.41 | 0.11 | 0.07 | 0 |
| 278 | P28807 | 0.45 | 0.22 | 0.09 | 1 |
| 279 | P80220 | 0.38 | 0.21 | 0.13 | 0 |
| 280 | P0C267 | 0.40 | 0.20 | 0.13 | 4 |
| 281 | Q2MI77 | 0.44 | 0.23 | 0.08 | 1 |
| 282 | Q2VEF5 | 0.44 | 0.23 | 0.08 | 1 |
| 283 | Q2PMR2 | 0.47 | 0.19 | 0.10 | 0 |
| 284 | P28803 | 0.44 | 0.21 | 0.07 | 2 |
| 285 | Q5G6V9 | 0.53 | 0.23 | 0.08 | 2 |
| 286 | A5YVF1 | 0.42 | 0.13 | 0.06 | 2 |
| 287 | P27807 | 0.52 | 0.15 | 0.05 | 0 |
| 288 | Q41418 | 0.41 | 0.20 | 0.10 | 2 |
| 289 | Q95H63 | 0.44 | 0.22 | 0.10 | 2 |

TABLE 3B

| Seq ID No | SolvScore | AggScore | Allergenicity | Toxicity | Antinutricity | Human Homology |
|---|---|---|---|---|---|---|
| 1 | −28.68 | 0.37 | 0.83 | 0.21 | 0.21 | 0.22 |
| 2 | −28.04 | 0.37 | 0.71 | 0.00 | 0.21 | 0.42 |
| 3 | −27.88 | 0.40 | 0.68 | 0.00 | 0.21 | 0.41 |
| 4 | −25.31 | 0.41 | 0.65 | 0.00 | 0.19 | 0.00 |
| 5 | −28.80 | 0.28 | 0.63 | 0.00 | 0.21 | 0.98 |
| 6 | −26.64 | 0.44 | 0.60 | 0.00 | 0.23 | 0.00 |
| 7 | −28.16 | 0.23 | 0.58 | 0.18 | 0.18 | 0.97 |
| 8 | −28.15 | 0.23 | 0.58 | 0.18 | 0.17 | 0.97 |
| 9 | −27.54 | 0.37 | 0.55 | 0.19 | 0.21 | 0.22 |
| 10 | −28.30 | 0.23 | 0.55 | 0.18 | 0.17 | 0.95 |
| 11 | −31.29 | 0.25 | 0.55 | 0.00 | 0.22 | 0.51 |
| 12 | −30.53 | 0.27 | 0.55 | 0.21 | 0.21 | 0.53 |
| 13 | −25.09 | 0.33 | 0.54 | 0.26 | 0.19 | 0.94 |
| 14 | −28.55 | 0.19 | 0.53 | 0.21 | 0.24 | 1.00 |
| 15 | −28.42 | 0.22 | 0.53 | 0.18 | 0.19 | 0.98 |
| 16 | −26.63 | 0.40 | 0.52 | 0.23 | 0.25 | 0.27 |
| 17 | −28.92 | 0.16 | 0.52 | 0.00 | 0.20 | 0.95 |
| 18 | −25.93 | 0.39 | 0.51 | 0.24 | 0.25 | 0.25 |
| 19 | −28.97 | 0.24 | 0.51 | 0.23 | 0.21 | 0.91 |
| 20 | −26.30 | 0.21 | 0.51 | 0.25 | 0.23 | 0.39 |
| 21 | −26.00 | 0.25 | 0.51 | 0.22 | 0.24 | 0.55 |
| 22 | −28.97 | 0.24 | 0.51 | 0.23 | 0.21 | 0.91 |
| 23 | −28.36 | 0.24 | 0.51 | 0.21 | 0.21 | 0.90 |

TABLE 3B-continued

| Seq ID No | SolvScore | AggScore | Allergenicity | Toxicity | Antinutricity | Human Homology |
|---|---|---|---|---|---|---|
| 24 | −28.97 | 0.24 | 0.51 | 0.23 | 0.21 | 0.91 |
| 25 | −28.98 | 0.24 | 0.51 | 0.23 | 0.21 | 0.90 |
| 26 | −29.02 | 0.23 | 0.51 | 0.23 | 0.21 | 0.89 |
| 27 | −29.01 | 0.23 | 0.51 | 0.23 | 0.21 | 0.90 |
| 28 | −28.50 | 0.19 | 0.51 | 0.24 | 0.19 | 0.91 |
| 29 | −25.19 | 0.42 | 0.50 | 0.24 | 0.25 | 0.25 |
| 30 | −26.03 | 0.27 | 0.50 | 0.23 | 0.22 | 0.36 |
| 31 | −26.52 | 0.36 | 0.50 | 0.00 | 0.21 | 0.37 |
| 32 | −27.66 | 0.23 | 0.50 | 0.00 | 0.24 | 1.00 |
| 33 | −28.96 | 0.24 | 0.49 | 0.22 | 0.21 | 0.91 |
| 34 | −25.05 | 0.40 | 0.49 | 0.24 | 0.24 | 0.00 |
| 35 | −28.96 | 0.24 | 0.49 | 0.22 | 0.21 | 0.91 |
| 36 | −28.97 | 0.24 | 0.49 | 0.22 | 0.21 | 0.89 |
| 37 | −26.04 | 0.25 | 0.49 | 0.22 | 0.24 | 0.54 |
| 38 | −28.96 | 0.24 | 0.49 | 0.22 | 0.21 | 0.91 |
| 39 | −29.48 | 0.26 | 0.49 | 0.00 | 0.22 | 0.65 |
| 40 | −29.44 | 0.24 | 0.49 | 0.22 | 0.22 | 0.91 |
| 41 | −29.00 | 0.21 | 0.49 | 0.24 | 0.21 | 0.89 |
| 42 | −28.98 | 0.24 | 0.48 | 0.24 | 0.19 | 0.91 |
| 43 | −29.54 | 0.25 | 0.48 | 0.00 | 0.23 | 0.64 |
| 44 | −28.98 | 0.23 | 0.48 | 0.00 | 0.19 | 0.91 |
| 45 | −30.31 | 0.28 | 0.47 | 0.25 | 0.24 | 0.90 |
| 46 | −25.90 | 0.32 | 0.47 | 0.00 | 0.23 | 0.00 |
| 47 | −27.55 | 0.34 | 0.46 | 0.22 | 0.24 | 0.64 |
| 48 | −28.99 | 0.30 | 0.45 | 0.00 | 0.00 | 0.47 |
| 49 | −25.35 | 0.18 | 0.45 | 0.20 | 0.22 | 0.98 |
| 139 | −33.88 | 0.00 | 0.15 | 0.37 | 0.30 | 0.90 |
| 140 | −37.24 | 0.12 | 0.34 | 0.22 | 0.25 | 0.97 |
| 141 | −36.00 | 0.11 | 0.34 | 0.25 | 0.26 | 1.00 |
| 142 | −35.85 | 0.01 | 0.18 | 0.30 | 0.28 | 1.00 |
| 143 | −33.70 | 0.25 | 0.29 | 0.00 | 0.00 | 0.00 |
| 144 | −32.94 | 0.12 | 0.33 | 0.21 | 0.25 | 0.35 |
| 145 | −32.77 | 0.23 | 0.34 | 0.00 | 0.00 | 0.78 |
| 146 | −32.65 | 0.32 | 0.31 | 0.23 | 0.27 | 0.25 |
| 147 | −32.38 | 0.21 | 0.33 | 0.00 | 0.22 | 0.38 |
| 148 | −32.24 | 0.12 | 0.33 | 0.19 | 0.21 | 0.22 |
| 149 | −32.09 | 0.27 | 0.28 | 0.00 | 0.00 | 0.00 |
| 150 | −31.90 | 0.29 | 0.29 | 0.00 | 0.00 | 0.00 |
| 151 | −31.90 | 0.29 | 0.29 | 0.00 | 0.00 | 0.00 |
| 152 | −31.80 | 0.29 | 0.30 | 0.20 | 0.00 | 0.71 |
| 153 | −31.78 | 0.19 | 0.33 | 0.24 | 0.25 | 0.98 |
| 154 | −31.47 | 0.24 | 0.35 | 0.00 | 0.00 | 0.77 |
| 155 | −31.44 | 0.25 | 0.30 | 0.00 | 0.17 | 0.31 |
| 156 | −30.95 | 0.17 | 0.32 | 0.22 | 0.26 | 0.93 |
| 157 | −30.92 | 0.34 | 0.30 | 0.22 | 0.25 | 0.27 |
| 158 | −30.74 | 0.25 | 0.30 | 0.00 | 0.00 | 0.30 |
| 159 | −30.74 | 0.25 | 0.30 | 0.00 | 0.00 | 0.30 |
| 160 | −30.60 | 0.25 | 0.29 | 0.00 | 0.00 | 0.31 |
| 161 | −30.53 | 0.08 | 0.31 | 0.00 | 0.30 | 0.29 |
| 162 | −30.34 | 0.15 | 0.35 | 0.00 | 1.00 | 0.78 |
| 163 | −30.30 | 0.11 | 0.35 | 0.00 | 0.22 | 0.46 |
| 164 | −30.30 | 0.11 | 0.35 | 0.00 | 0.22 | 0.46 |
| 165 | −30.25 | 0.18 | 0.34 | 0.00 | 0.24 | 0.42 |
| 166 | −29.86 | 0.19 | 0.34 | 0.00 | 0.23 | 0.21 |
| 167 | −29.72 | 0.30 | 0.35 | 0.18 | 0.20 | 0.37 |
| 168 | −29.39 | 0.35 | 0.31 | 0.20 | 0.00 | 1.00 |
| 169 | −29.33 | 0.23 | 0.28 | 0.00 | 0.27 | 0.65 |
| 170 | −29.26 | 0.21 | 0.30 | 0.25 | 0.28 | 0.78 |
| 171 | −29.25 | 0.22 | 0.31 | 0.00 | 0.22 | 0.69 |
| 172 | −29.22 | 0.40 | 0.27 | 0.26 | 0.00 | 0.93 |
| 173 | −29.20 | 0.07 | 0.30 | 0.00 | 0.30 | 0.31 |
| 174 | −29.17 | 0.23 | 0.29 | 0.21 | 0.27 | 0.71 |
| 175 | −29.09 | 0.24 | 0.30 | 0.00 | 0.22 | 0.85 |
| 176 | −29.05 | 0.29 | 0.33 | 0.00 | 0.19 | 0.37 |
| 177 | −28.89 | 0.08 | 0.28 | 0.21 | 0.24 | 0.29 |
| 178 | −28.81 | 0.21 | 0.28 | 0.25 | 0.23 | 0.28 |
| 179 | −28.73 | 0.25 | 0.34 | 0.24 | 0.00 | 1.00 |
| 180 | −28.69 | 0.26 | 0.30 | 0.00 | 0.22 | 0.38 |
| 181 | −28.66 | 0.08 | 0.32 | 0.26 | 0.29 | 0.00 |
| 182 | −28.49 | 0.18 | 0.27 | 0.00 | 0.23 | 1.00 |
| 183 | −28.45 | 0.08 | 0.23 | 0.26 | 0.00 | 0.82 |
| 184 | −28.41 | 0.25 | 0.29 | 0.24 | 0.17 | 0.71 |
| 185 | −28.35 | 0.25 | 0.34 | 0.18 | 0.00 | 0.19 |
| 186 | −28.33 | 0.16 | 0.33 | 0.00 | 0.00 | 0.90 |
| 187 | −28.32 | 0.20 | 0.34 | 0.00 | 0.24 | 0.00 |
| 188 | −28.31 | 0.07 | 0.31 | 0.00 | 0.30 | 0.31 |
| 189 | −28.30 | 0.16 | 0.27 | 0.25 | 0.00 | 0.31 |

TABLE 3B-continued

| Seq ID No | SolvScore | AggScore | Allergenicity | Toxicity | Antinutricity | Human Homology |
|---|---|---|---|---|---|---|
| 190 | −28.17 | 0.27 | 0.26 | 0.00 | 0.23 | 0.78 |
| 191 | −28.05 | 0.26 | 0.29 | 0.25 | 0.00 | 0.26 |
| 192 | −28.03 | 0.22 | 0.33 | 0.21 | 0.00 | 0.00 |
| 193 | −28.01 | 0.09 | 0.30 | 0.27 | 0.32 | 0.32 |
| 194 | −28.00 | 0.34 | 0.31 | 0.00 | 0.21 | 0.29 |
| 195 | −27.93 | 0.24 | 0.31 | 0.21 | 0.00 | 0.99 |
| 196 | −27.86 | 0.17 | 0.26 | 0.33 | 0.29 | 0.38 |
| 197 | −27.78 | 0.25 | 0.30 | 0.27 | 0.18 | 0.70 |
| 198 | −27.76 | 0.38 | 0.23 | 0.00 | 0.27 | 0.31 |
| 199 | −27.76 | 0.38 | 0.23 | 0.00 | 0.27 | 0.31 |
| 200 | −27.75 | 0.45 | 0.30 | 0.27 | 0.25 | 0.00 |
| 201 | −27.72 | 0.07 | 0.31 | 0.24 | 0.30 | 0.27 |
| 202 | −27.70 | 0.33 | 0.34 | 0.26 | 0.26 | 0.56 |
| 203 | −27.64 | 0.33 | 0.32 | 0.00 | 0.27 | 0.99 |
| 204 | −27.63 | 0.23 | 0.30 | 0.21 | 0.23 | 0.55 |
| 205 | −27.63 | 0.23 | 0.30 | 0.21 | 0.23 | 0.55 |
| 206 | −27.63 | 0.29 | 0.33 | 0.00 | 0.23 | 0.47 |
| 207 | −27.55 | 0.25 | 0.31 | 0.25 | 0.25 | 0.62 |
| 208 | −27.55 | 0.35 | 0.32 | 0.21 | 0.00 | 0.41 |
| 209 | −27.52 | 0.30 | 0.25 | 0.24 | 0.26 | 0.26 |
| 210 | −27.51 | 0.17 | 0.30 | 0.27 | 0.22 | 0.53 |
| 211 | −27.44 | 0.21 | 0.30 | 0.24 | 0.24 | 0.42 |
| 212 | −27.42 | 0.23 | 0.35 | 0.00 | 0.21 | 0.24 |
| 213 | −27.42 | 0.12 | 0.33 | 0.27 | 0.26 | 0.91 |
| 214 | −27.35 | 0.28 | 0.33 | 0.00 | 0.22 | 0.19 |
| 215 | −27.34 | 0.22 | 0.33 | 0.24 | 0.25 | 0.27 |
| 216 | −27.32 | 0.14 | 0.30 | 0.00 | 0.24 | 1.00 |
| 217 | −27.26 | 0.16 | 0.33 | 0.00 | 0.21 | 0.87 |
| 218 | −27.26 | 0.44 | 0.29 | 0.26 | 0.25 | 0.00 |
| 219 | −27.25 | 0.26 | 0.31 | 0.22 | 0.25 | 0.51 |
| 220 | −27.25 | 0.26 | 0.31 | 0.22 | 0.25 | 0.51 |
| 221 | −27.25 | 0.41 | 0.32 | 0.25 | 0.21 | 0.43 |
| 222 | −27.24 | 0.32 | 0.34 | 0.20 | 0.19 | 0.85 |
| 223 | −27.23 | 0.46 | 0.29 | 0.27 | 0.25 | 0.00 |
| 224 | −27.23 | 0.46 | 0.29 | 0.27 | 0.25 | 0.00 |
| 225 | −27.20 | 0.29 | 0.29 | 0.25 | 0.28 | 0.26 |
| 226 | −27.19 | 0.24 | 0.33 | 0.21 | 0.24 | 0.62 |
| 227 | −27.19 | 0.24 | 0.33 | 0.21 | 0.24 | 0.62 |
| 228 | −27.18 | 0.23 | 0.32 | 0.24 | 0.26 | 0.64 |
| 229 | −27.14 | 0.18 | 0.33 | 0.00 | 0.20 | 0.00 |
| 230 | −27.13 | 0.17 | 0.35 | 0.00 | 0.22 | 0.46 |
| 231 | −27.11 | 0.25 | 0.30 | 0.23 | 0.22 | 0.36 |
| 232 | −27.10 | 0.18 | 0.34 | 0.00 | 0.21 | 0.00 |
| 233 | −27.09 | 0.26 | 0.30 | 0.25 | 0.25 | 0.45 |
| 234 | −27.09 | 0.26 | 0.30 | 0.25 | 0.25 | 0.45 |
| 235 | −27.09 | 0.30 | 0.32 | 0.24 | 0.23 | 0.57 |
| 236 | −27.08 | 0.23 | 0.31 | 0.24 | 0.28 | 0.61 |
| 237 | −27.08 | 0.23 | 0.31 | 0.24 | 0.28 | 0.61 |
| 238 | −27.08 | 0.23 | 0.33 | 0.21 | 0.00 | 0.61 |
| 239 | −27.07 | 0.38 | 0.26 | 0.00 | 0.26 | 0.32 |
| 240 | −27.06 | 0.25 | 0.22 | 0.28 | 0.26 | 0.25 |
| 241 | −27.05 | 0.26 | 0.30 | 0.23 | 0.25 | 0.37 |
| 242 | −27.02 | 0.33 | 0.31 | 0.00 | 0.24 | 0.55 |
| 243 | −27.01 | 0.34 | 0.32 | 0.27 | 0.24 | 1.00 |
| 244 | −27.01 | 0.34 | 0.32 | 0.27 | 0.24 | 1.00 |
| 245 | −26.92 | 0.26 | 0.26 | 0.25 | 0.24 | 0.27 |
| 246 | −26.91 | 0.14 | 0.32 | 0.00 | 0.00 | 0.84 |
| 247 | −26.88 | 0.18 | 0.28 | 0.25 | 0.28 | 1.00 |
| 248 | −26.88 | 0.13 | 0.32 | 0.00 | 0.24 | 0.56 |
| 249 | −26.85 | 0.18 | 0.33 | 0.00 | 0.20 | 0.00 |
| 250 | −26.83 | 0.34 | 0.33 | 0.00 | 0.25 | 0.33 |
| 251 | −26.81 | 0.14 | 0.32 | 0.19 | 0.20 | 0.21 |
| 252 | −26.80 | 0.38 | 0.33 | 0.00 | 0.20 | 0.26 |
| 253 | −26.80 | 0.34 | 0.32 | 0.00 | 0.23 | 0.50 |
| 254 | −26.78 | 0.08 | 0.28 | 0.23 | 0.00 | 0.99 |
| 255 | −26.74 | 0.38 | 0.30 | 0.23 | 0.29 | 0.56 |
| 256 | −26.70 | 0.21 | 0.30 | 0.20 | 0.27 | 0.59 |
| 257 | −26.68 | 0.25 | 0.30 | 0.21 | 0.23 | 0.65 |
| 258 | −26.62 | 0.24 | 0.31 | 0.25 | 0.25 | 0.66 |
| 259 | −26.62 | 0.21 | 0.32 | 0.00 | 0.23 | 0.83 |
| 260 | −26.62 | 0.33 | 0.32 | 0.00 | 0.00 | 1.00 |
| 261 | −26.60 | 0.32 | 0.32 | 0.00 | 0.21 | 0.51 |
| 262 | −26.58 | 0.20 | 0.34 | 0.21 | 0.21 | 0.88 |
| 263 | −26.56 | 0.27 | 0.34 | 0.00 | 0.00 | 0.54 |
| 264 | −26.56 | 0.35 | 0.32 | 0.00 | 0.24 | 0.97 |
| 265 | −26.56 | 0.30 | 0.32 | 0.25 | 0.00 | 0.34 |
| 266 | −26.55 | 0.32 | 0.32 | 0.21 | 0.23 | 0.48 |

TABLE 3B-continued

| Seq ID No | SolvScore | AggScore | Allergenicity | Toxicity | Antinutricity | Human Homology |
|---|---|---|---|---|---|---|
| 267 | −26.54 | 0.20 | 0.33 | 0.27 | 0.28 | 0.90 |
| 268 | −26.53 | 0.27 | 0.33 | 0.22 | 0.20 | 0.29 |
| 269 | −26.52 | 0.17 | 0.30 | 0.19 | 0.23 | 0.57 |
| 270 | −26.52 | 0.23 | 0.34 | 0.23 | 0.22 | 0.23 |
| 271 | −26.52 | 0.46 | 0.31 | 0.23 | 0.26 | 0.99 |
| 272 | −26.52 | 0.46 | 0.31 | 0.23 | 0.26 | 0.99 |
| 273 | −26.51 | 0.22 | 0.31 | 0.27 | 0.20 | 0.57 |
| 274 | −26.51 | 0.27 | 0.34 | 0.00 | 0.00 | 0.54 |
| 275 | −26.49 | 0.33 | 0.31 | 0.24 | 0.23 | 1.00 |
| 276 | −26.48 | 0.19 | 0.31 | 0.00 | 0.21 | 0.58 |
| 277 | −26.46 | 0.11 | 0.30 | 0.26 | 0.26 | 1.00 |
| 278 | −26.45 | 0.33 | 0.28 | 0.00 | 0.25 | 0.29 |
| 279 | −26.42 | 0.21 | 0.34 | 0.00 | 0.29 | 0.95 |
| 280 | −26.40 | 0.33 | 0.34 | 0.00 | 0.24 | 0.85 |
| 281 | −26.38 | 0.32 | 0.27 | 0.22 | 0.22 | 0.31 |
| 282 | −26.38 | 0.32 | 0.27 | 0.22 | 0.22 | 0.31 |
| 283 | −26.37 | 0.25 | 0.31 | 0.00 | 0.24 | 0.29 |
| 284 | −26.34 | 0.33 | 0.30 | 0.20 | 0.23 | 0.31 |
| 285 | −26.34 | 0.43 | 0.29 | 0.00 | 0.28 | 1.00 |
| 286 | −26.32 | 0.16 | 0.33 | 0.00 | 0.20 | 0.20 |
| 287 | −26.31 | 0.22 | 0.33 | 0.25 | 0.23 | 0.57 |
| 288 | −26.31 | 0.32 | 0.32 | 0.20 | 0.00 | 0.75 |
| 289 | −26.31 | 0.38 | 0.25 | 0.00 | 0.27 | 0.29 |

Example 2

Protein Expression

Genes encoding nutritive proteins of this disclosure were codon optimized for expression in *Escherichia coli* and synthesized by either LifeTechnologies/GeneArt or DNA 2.0. Genes were designed to express the native protein or to contain one of two amino-terminal tags to facilitate purification:

```
                        (SEQ ID NO: 495)
MGSHHHHHHHH (SEQ ID NO: 494)
MGSSHHHHHHSSGLVPRGSH
```

These gene constructs were inserted into the pET15b plasmid vector (Novagen) using NcoI-BamHI restriction sites (in case of the first tag) or using the NdeI-BamHI restriction sites (in the case of the second tag). All restriction enzymes were purchased from New England Biolabs. Plasmids were transformed into *Escherichia coli* T7 Express (New England Biolabs) and selected on lysogeny broth (LB) plates containing 100 mg/l carbenicillin. A single colony was picked, grown to $OD_{600nm} \approx 0.6$ in LB with 100 mg/l carbencillin, and stored as a glycerol stock (in LB with 10% glycerol (v/v)) at −80° C., to serve as a master cell stock.

2 ml LB with 100 mg/l carbenicillin (in a 14 mm×100 mm culture tube) was inoculated with a stab from the glycerol stock and grown overnight at 37° C. and 250 rpm. The next day, 2 ml LB with 100 mg/l carbenicillin (in a 14 mm×100 mm culture tube) was inoculated with the overnight culture to $OD_{600nm}$=0.05 and grown at 30° C. or 37° C. and 250 rpm. At $OD_{600nm} \approx 0.8$, heterologous gene-expression was initiated with 1 mM isopropyl β-D-1-thiogalactopyranoside (IPTG) and grown for another 2 hr (when grown at 37° C.) or 4 hr (when grown at 30° C.) until harvest. Upon harvesting, $OD_{600nm}$ was measured, a 1 ml aliquot was centrifuged, and the supernatant was decanted. Cells were re-suspended to $OD_{600nm}$=1.50 for SDS-PAGE analysis to evaluate expression level. 10 μl of resuspended culture was loaded onto either: 1) a Novex® NuPAGE® 12% Bis-Tris gel (Life Technologies), or 2) a Novex®16% Tricine gel (Life Technologies), and run using standard manufacturer's protocols. Gels were stained using SimplyBlue™ SafeStain (Life Technologies) using the standard manufacturer's protocol and imaged using the Molecular Imager® Gel Doc™ XR+ System (Bio-Rad). Over-expressed heterologous protein was identified by comparison against a molecular weight marker and control cultures.

Using this method, recombinant expression of the proteins listed in Tables 4A and 4B was observed.

TABLE 4A

| Seq ID No | UniProt | EAA | BCAA | L | C |
|---|---|---|---|---|---|
| 464 | P02754 | 0.50 | 0.26 | 0.15 | 7 |
| 465 | P02662 | 0.44 | 0.21 | 0.10 | 1 |
| 466 | P29290 | 0.45 | 0.21 | 0.10 | 0 |
| 467 | Q5ZMN0 | 0.34 | 0.20 | 0.14 | 2 |
| 468 | P35622 | 0.49 | 0.20 | 0.10 | 4 |
| 469 | P02586 | 0.42 | 0.16 | 0.06 | 1 |
| 470 | P63317 | 0.46 | 0.18 | 0.08 | 2 |
| 471 | P63315 | 0.46 | 0.18 | 0.08 | 2 |
| 472 | P29290 | 0.47 | 0.21 | 0.09 | 0 |
| 473 | P60660 | 0.47 | 0.20 | 0.09 | 3 |
| 474 | P02607 | 0.46 | 0.18 | 0.09 | 4 |
| 475 | P02605 | 0.48 | 0.19 | 0.08 | 1 |
| 476 | Q41784 | 0.43 | 0.17 | 0.08 | 11 |
| 477 | P02587 | 0.42 | 0.16 | 0.05 | 1 |
| 478 | P10246 | 0.45 | 0.16 | 0.06 | 1 |
| 479 | Q030J7 | 0.50 | 0.25 | 0.08 | 0 |
| 480 | Q8DHS3 | 0.45 | 0.28 | 0.10 | 0 |
| 481 | Q5FJI8 | 0.46 | 0.22 | 0.06 | 0 |
| 482 | Q9WZD0 | 0.51 | 0.29 | 0.10 | 0 |
| 483 | Q74IP1 | 0.45 | 0.20 | 0.06 | 0 |
| 484 | Q84MN0 | 0.45 | 0.19 | 0.09 | 1 |
| 485 | P41040 | 0.45 | 0.18 | 0.08 | 1 |
| 486 | P06787 | 0.44 | 0.23 | 0.13 | 0 |
| 487 | P93087 | 0.46 | 0.17 | 0.07 | 1 |
| 488 | P52193 | 0.42 | 0.14 | 0.06 | 3 |
| 489 | Q9SP22 | 0.44 | 0.14 | 0.05 | 2 |
| 490 | P67975 | 0.50 | 0.25 | 0.13 | 5 |

TABLE 4B

| Seq ID No | SolvScore | AggScore | Allergenicity | Toxicity | Antinutricity | Human Homology |
|---|---|---|---|---|---|---|
| 464 | −20.98 | 0.56 | 1.00 | 0.00 | 0.24 | 0.44 |
| 465 | −21.19 | 0.32 | 1.00 | 0.23 | 0.23 | 0.35 |
| 466 | −30.62 | 0.31 | 0.98 | 0.23 | 0.00 | 0.41 |
| 467 | −38.14 | 0.22 | 0.41 | 0.23 | 0.25 | 0.64 |
| 468 | −32.67 | 0.32 | 0.54 | 0.26 | 0.25 | 0.37 |
| 469 | −30.64 | 0.26 | 0.45 | 0.25 | 0.22 | 0.99 |
| 470 | −31.40 | 0.32 | 0.43 | 0.21 | 0.22 | 0.99 |
| 471 | −31.40 | 0.32 | 0.43 | 0.21 | 0.22 | 0.99 |
| 472 | −29.63 | 0.32 | 1.00 | 0.25 | 0.00 | 0.37 |
| 473 | −23.50 | 0.38 | 0.46 | 0.00 | 0.18 | 1.00 |
| 474 | −23.76 | 0.32 | 0.45 | 0.22 | 0.23 | 0.91 |
| 475 | −23.80 | 0.35 | 0.49 | 0.23 | 0.27 | 0.84 |
| 476 | −19.97 | 0.34 | 0.54 | 0.00 | 0.21 | 0.88 |
| 477 | −30.84 | 0.27 | 0.45 | 0.25 | 0.23 | 0.98 |
| 478 | −30.31 | 0.28 | 0.47 | 0.25 | 0.24 | 0.90 |
| 479 | −33.16 | 0.40 | 0.24 | 0.34 | 0.00 | 0.29 |
| 480 | −27.07 | 0.41 | 0.30 | 0.41 | 0.24 | 0.43 |
| 481 | −29.97 | 0.29 | 0.35 | 0.42 | 0.30 | 0.36 |
| 482 | −29.38 | 0.37 | 0.29 | 0.38 | 0.23 | 0.36 |
| 483 | −30.86 | 0.24 | 0.30 | 0.38 | 0.00 | 0.40 |
| 484 | −27.55 | 0.34 | 0.46 | 0.22 | 0.24 | 0.64 |
| 485 | −28.96 | 0.24 | 0.49 | 0.22 | 0.21 | 0.91 |
| 486 | −23.64 | 0.35 | 0.46 | 0.25 | 0.26 | 0.59 |
| 487 | −29.02 | 0.23 | 0.51 | 0.23 | 0.21 | 0.89 |
| 488 | −30.63 | 0.26 | 0.49 | 0.00 | 0.22 | 0.93 |
| 489 | −31.29 | 0.25 | 0.55 | 0.00 | 0.22 | 0.51 |
| 490 | −21.19 | 0.47 | 0.99 | 0.22 | 0.24 | 0.43 |

Example 3

Scaled Up Production of Recombinant Nutritive Proteins

A representative protocol for producing quantities of nutritive proteins as described in this disclosure is as follows.

5 ml LB with 100 mg/l carbenicillin (in a 50 ml baffled Pyrex shake flask) is inoculated with a stab from the glycerol stock of a recombinant E. coli strain comprising a recombinant gene encoding a nutritive protein and grown until late exponential phase (OD600 nm≈2) at 37° C. and 250 rpm. A 2.5 l Ultra Yield Flask (Thomson Instrument Company) is inoculated with 500 ml sterile water and enough EnBase EnPresso™ tablets (BioSilta) to formulate 500 ml growth medium. This medium is supplemented with 100 mg/l carbenicillin, 0.001% Industrol 204 antifoam, and 0.6 U/l EnzI'm (BioSilta). The shake flask is inoculated to OD600 nm=0.05 and grown 16 hr at 30° C. and 250 rpm. The growth medium is supplemented with EnPresso™ Booster tablets (BioSilta), 1.2 U/l EnzI'm, and 1 mM IPTG to induce heterologous protein production. After another 8-24 hr of shaking at 30° C. and 250 rpm, the flask is harvested by centrifugation, the supernatant is decanted, and the wet cell weight was measured. Approximately 20 gWCW (grams wet cell weight)/l medium is typically recovered at this stage.

The harvested cells from each shake-flask fermentation are suspended in 25 mL of IMAC Equilibration Solution (30 mM Imidazole, 50 mM Phosphate, 0.5 M NaCl, pH 7.5). The suspended cells are then lysed by sonication on ice. The lysed cells are centrifuged for 60 minutes and decanted. The cell debris is discarded, and the supernatants are 0.2 µm filtered. Filters are then flushed with an additional 10 mL of IMAC Equilibration Solution. These filtered protein solutions are then purified by immobilized metal affinity chromatography (IMAC).

IMAC resin (GE Healthcare, IMAC Sepharose 6 Fast Flow) is charged with nickel and equilibrated. 30 mL of each protein solution is loaded onto a 5 mL IMAC column, and washed with additional equilibration solution to remove unbound impurities. The protein of interest is then eluted with 15 mL of 0.5 M NaCl, 0.2 M Imidazole, pH 7.5. At this stage, the purified proteins are typically shown to be at least 90% pure by SDS-PAGE. Approximately 20 to 60 mg of each protein is recovered in the IMAC elution fractions. Each IMAC elution fraction is buffer exchanged by dialysis into a formulation solution (20 mM HEPES, pH 7.5). After buffer exchange, the protein solutions are recovered for all downstream processing.

Example 4

Prediction of Soluble Expression of Nutritive Proteins

Open reading frames encoding a set of 292 nutritive proteins were cloned and introduced into E. coli to assess recombinant protein expression using the method of Example 2. In the system used, 163 proteins were identified as expressed while 129 were not. Of the 163 proteins that expressed, 125 were tested for soluble expression. It was found that 75 were solubly expressed while 50 were not.

FIG. 1 shows a two dimensional histogram of protein expression in the E. coli expression screen. FIG. 1 shows the relative likelihood (on a log scale) of a protein being expressed as a function of solvation score (y-axis) and aggregation score α-axis). A darker mark on the histogram indicates a higher number of proteins expressed, while a lighter mark indicates a fewer number of proteins expressed. FIG. 1 shows that those proteins that were successfully expressed tend to cluster in the top left region of the plot, where the solvation score is more negative (≤−20) and the aggregation score is smaller (≤0.75). There were few examples of proteins that were successfully expressed with less negative solvation scores (≥−15) and large aggregation scores (≥1). This result suggests that nutritive proteins with solvation scores of −20 or less and aggregation scores of 0.75 or less are more likely to be expressed in this system.

Figure 2:
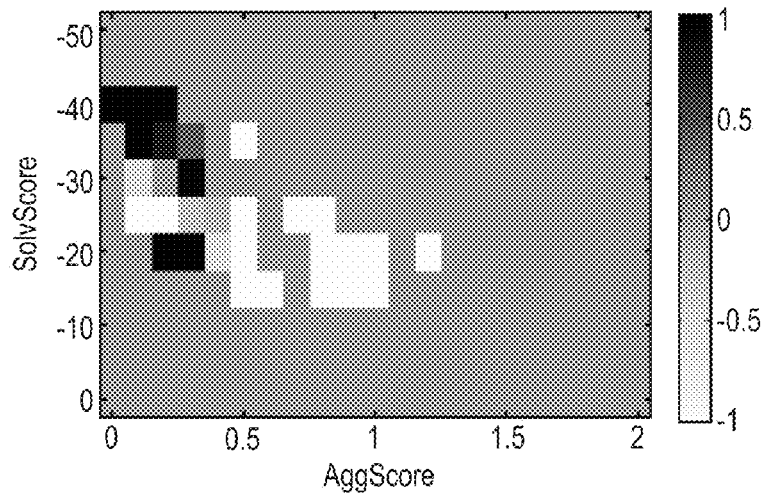
FIG. 2 shows a two dimensional histogram indicating the relative likelihood (on a log scale) of a protein being solubly expressed in an *E. coli* expression screen as a function of solvation score (y-axis) and aggregation score (x-axis).

FIG. 2 shows a two dimensional histogram of the number of soluble protein expression in the *E. coli* expression screen. FIG. 2 shows the relative likelihood (on a log scale) of a protein being solubly expressed as a function of solvation score (y-axis) and aggregation score (x-axis). Again, a darker mark on the histogram indicates a higher number of proteins expressed, while a lighter mark indicates a fewer number of proteins expressed. FIG. 2 shows that those proteins that were expressed solubly tended to cluster in the top left region of the plot, where the solvation score is more negative (≤−20) and the aggregation score is smaller (≤0.5). There were few examples of proteins that were expressed solubly with less negative solvation scores (≥−15) and large aggregation scores (≥0.75). This result suggests that nutritive proteins with solvation scores of −20 or less and aggregation scores of 0.5 or less are more likely to be solubly expressed in this system.

Example 5

Solubility Screening

The solubility of nine nutritive proteins produced as described Examples 2 and 3 was examined by centrifuge concentration followed by protein concentration assays. Samples in 20 mM HEPES pH 7.5 were tested for protein concentration according to the protocol for Coomassie Plus (Bradford) Protein Assay (Thermo Scientific) and absorbance at 280 nm (if applicable). Based on these measurements 10 mg of protein was added to an Amicon Ultra 3 kDa centrifugal filter (Millipore). Samples were concentrated by centrifugation at 10,000×g for 30 minutes. The final concentrated samples were examined for precipitated protein and color, and then tested for protein concentration as described above. The results are shown in Table 5.

TABLE 5

| Seq ID No | Appearance | Concentration (g/L) |
|---|---|---|
| 466 | Clear Faint Yellow | 265 |
| 467 | Clear Colorless | 53 |
| 475 | Clear Yellow | 176 |
| 480 | Clear Colorless | 91 |
| 481 | Clear Colorless | 107 |
| 483 | Clear Colorless | 120 |
| 484 | Clear Faint Yellow | 133 |
| 485 | Clear Faint Yellow | 192 |
| 486 | Clear Faint Yellow | 335 |

The solubilities of these nutritive proteins were found to be significantly higher than concentrations typically found for whey (12.5 g/L) and soy (10 g/L) (Pelegrine, D. H. G. & Gasparetto, C. A., 2005. Whey proteins solubility as function of temperature and pH. LWT—Food Science and Technology, p. 77-80; Lee, K. H., Ryu, H. S. & and Rhee, K. C., 2003. Protein solubility characteristics of commercial soy protein products. Journal of the American Oil Chemists' Society, pp. 85-90). This demonstrates the usefulness of the nutritive proteins disclosed herein. For example, the solubility of nutritive proteins may improve compliant delivery of high quality protein in as small of a volume as possible while avoiding the "chalkyness" that often characterizes proteins delivered in this manner. This may, for example, be useful to deliver proteins to the elderly or other subjects.

Example 6

Stability Screening

Thermal stability of nutritive proteins provides insight regarding whether the protein is likely to have a useful shelf life. Samples of proteins produced as described in Examples 6 and 7 were screened in parallel using a rapid thermal stability screening method. In this method proteins were heated slowly from 25° C. to 95° C. in two representative formulations in the presence of a hydrophobic dye (Enzo Life Sciences, ProteoStat® Thermal shift stability assay kit) that binds to aggregated proteins that form as the protein denatures with increasing temperature (Niesen, F. H., Berglund, H. & Vadadi, M., 2007. The use of differential scanning fluorimetry to detect ligand interactions that promote protein stability. Nature Protocols, Volume 2, pp. 2212-2221.). Upon binding, the dye's fluorescence increases significantly, which is then recorded by the rtPCR instrument and represented as the protein's melting curve (Lavinder, J. J., Hari, S. B., Suillivan, B. J. & Magilery, T. J., 2009. High-Throughput Thermal Scanning: A General, Rapid Dye-Binding Thermal Shift Screen for Protein Engineering. *Journal of the American Chemical Society*, pp. 3794-3795.). After the thermal shift is complete samples were examined for insoluble precipitates and further analyzed by analytical size exclusion chromatography (SEC).

Protein solutions (12.5 mg/ml) were prepared in both PBS and 20 mM HEPES pH 7.7 buffers, each containing 1× ProteoStat TS Detection Reagent. Samples of each solution were heated slowly from 25° C.-95° C., 0.5° C./30 seconds using a real-time PCR (rtPCR) thermocycler while monitoring the fluorescence of the dye. From this thermal scan the temperature of aggregation was determined ($T_{agg}$) from the temperature with the strongest slope if an increase in fluorescence was observed. To supplement the assay, samples were taken before and after the thermal shift and analyzed by SEC (GE Healthcare—Superdex 75 5/150) which can detect large soluble aggregates. The results for three nutritive proteins of this disclosure and a whey standard are presented in Table 6. The presence of soluble aggregates detected by SEC is noted by a "yes" if observed or "no" if not observed, and the "n/a" entries for the whey standard indicate the production of insoluble precipitates such that no SEC analysis was performed. For the nutritive proteins a "-" indicates that the assay was not performed.

TABLE 6

| Seq ID No | HEPES-$T_{agg}$ | PBS-$T_{agg}$ | HEPES-SEC Agg? | PBS-SEC Agg? |
|---|---|---|---|---|
| 466 | 95 | — | — | — |
| 467 | 55.5 | 54.5 | Yes | Yes |
| 471 | 95 | — | — | — |
| 475 | 95 | — | — | — |
| 479 | 95 | — | No | — |
| 480 | 64.5 | 59.5 | Yes | Yes |
| 481 | 95 | 95 | No | No |
| 483 | 95 | 95 | No | No |
| 484 | 95 | — | Yes | — |
| 485 | 95 | — | Yes | — |
| 486 | 95 | 95 | No | No |
| whey | 79 | 81.5 | n/a | n/a |

As shown in Table 6, many of the proteins have a higher HEPES $T_{agg}$ than whey and some do not form any aggregates at 95° C. (which was the upper limit of the assay), and are thus expected to be more stable than whey.

Example 7

Digestibility Screening—Determination of Digestion Half-Life

The goal of screening for protein digestibility is to eliminate potentially unsafe allergenic proteins and to determine the relative completeness of digestion as a predictor of peptide bioavailability. This screening method utilizes a physiologically relevant in vitro digestion reaction that includes both phases of protein digestion, simulated gastric digestion and simulated intestinal digestion (Moreno, J. F. et al., 2005. Stability of the major allergen Brazil nut 2S albumin (Ber e 1) to physiologically relevant in vitro gastrointestinal digestion. FEBS Journal, pp. 341-352.). Samples can be taken throughout the reaction and analyzed for intact protein and peptide fragments using chip electrophoresis and LC-QTOF-MS. Proteins with allergenic properties can be assessed by identifying proteins or large fragments of proteins that are resistant to digestive proteases and thus have a higher risk of causing an allergenic reaction (Goodman, R. E. et al., 2008. Allergenicity assessment of genetically modified crops—what makes sense?. Nature Biotechnology, pp. 73-81.). Digestibility is measured by determining how efficiently the protein is broken down into peptides (Daniel, H., 2003. Molecular and Integrative Physiology of Intestinal Peptide Transport. Annual Review of Physiology, Volume 66, pp. 361-384.).

The method used an automated assay for in vitro digestions of proteins wherein assay conditions and protease concentrations are physiologically relevant (Moreno, F. J., Mackie, A. R. & Clare Mills, E. N., 2005. Phospholipid interactions protect the milk allergen a-Lactalbumin from proteolysis during in vitro digestion. Journal of agricultural and food chemistry, pp. 9810-9816; Martos, G., Contreras, P., Molina, E. & Lopez-Fandino, R., 2010. Egg White Ovalbumin Digestion Mimicking Physiological Conditions. Journal of Agricultural and food chemistry, pp. 5640-5648; Moreno, J. F. et al., 2005. Stability of the major allergen Brazil nut 2S albumin (Ber e 1) to physiologically relevant in vitro gastrointestinal digestion. FEBS Journal, pp. 341-352.). The first phase of digestion is in simulated gastric fluid (SGF) and formulated at pH 1.5 and with a pepsin:substrate ratio of (1:10 w/w). The second phase of digestion is in simulated intestinal fluid (SIF) is formulated with bile salts at pH 6.5 and with an trypsin: chymotrypsin: substrate ratio of (1:4:400 w/w). The protein is treated for 120 mins in the simulated gastric fluid, which is how long it takes for 90% of a liquid meal to pass from the stomach to the small intestine (Kong, F. & Singh, R. P., 2008. Disintegration of Solid Foods in Human Stomach. *Journal of Food Science*, pp. 67-80), and then treated with simulated intestinal fluid for 120 mins. Sample time points are taken throughout both reactions and quenched for analysis. Bovine serum albumin, which is readily digested by pepsin, is the positive control for the SGF solution, and beta-lactoglobulin, which is naturally resistant to pepsin but digested in SIF, is the positive control for SIF solution. Intact protein and large fragments were detected using electrophoresis. For chip electrophoresis, a Caliper Labchip GXII equipped with a HT Low MW Protein Assay Kit was used to monitor the size and amount of intact protein as well as any digestion fragments larger than 4 kDa. By monitoring the amount of intact protein observed over time, the half-life ($\tau_{1/2}$) of digestion was calculated for SGF and, if intact protein is detected after SGF digestion, in SIF.

This method was used to analyze the digestion half-lives of eleven nutritive proteins of this disclosure produced as described in Examples 2 and 3, as well as native and recombinant ovalbumin (OVA and rOVA, respectively; SEQ ID NO: 491) and beta-lactoglobulin (BLG and rBLG, respectively; SEQ ID NO: 464) proteins and a whey standard. The results of these experiments are summarized in Table 7. An "n/a" entry in the Simulated Intestinal Fluid field indicates that no intact protein was detected after SGF digestion.

TABLE 7

| | Digestion $\tau_{1/2}$ (min.) | |
|---|---|---|
| Seq ID No. | Simulated Gastric Fluid | Simulated Intestinal Fluid |
| 466 | 0.9 | n/a |
| 467 | 3 | n/a |
| 471 | 0.3 | n/a |
| 475 | 0.3 | n/a |
| 479 | 0.4 | n/a |
| 480 | 1 | n/a |
| 481 | 2 | n/a |
| 483 | 0.6 | n/a |
| 484 | 0.3 | n/a |
| 485 | 0.3 | n/a |
| 486 | 0.7 | n/a |
| BLG (464) | 77 | 4 |
| rBLG (464) | 50 | 0.7 |
| OVA (491) | 18 | 1 |
| rOVA (491) | 5 | n/a |
| whey | 99 | 4 |

The results shown in Table 7 indicate that the eleven nutritive proteins of this disclosure were all completely digested by SGF and have SGF half lives of two minutes or less. By comparison whey is not completely digested by SGF and has an SGF half life of 99 minutes and a SIF half life of 4 minutes. This study suggests that the nutritive proteins of this disclosure are likely to be readily digested and not likely to elicit an allergic response when ingested.

The results in Table 7 also show that the recombinant beta-lactoglobulin and ovalbumin produced according to this disclosure were both more readily digested than their naturally-occurring counterparts. The speed in which a protein is broken down can be controlled by selecting for properties that improve or limit accessibility of the gastrointestinal proteases. This capability can be demonstrated for two typical protein properties, glycosylation and disulfide cross-linking Like many naturally occurring proteins, naturally occurring OVA and BLG are glycosylated by their host organisms. In contrast, the recombinant proteins produced according to the present disclosure are not glycosylated because the host organism (*E. coli* in this case) does not glycosylate. The lack of glycosylation in recombinant nutritive proteins according to this disclosure may result in proteins that are more readily digested. Furthermore, BLG has four disulfide bonds that are known to slow down or interfere with digestion. When these disulfide bonds are disrupted, the rate of digestion increases (Reddy, I. M., Kella, N. K. D. & Kinsella, J. E., 1988. Structural and conformational Basis of the Resistance of b-Lactoglobulin to Peptic and Chymotryptic Digestion. *J. Agric. Food Chem.*, Volume 36, pp. 737-741). A lack or disruption of disulfide bond formation in recombinant nutritive proteins according to this disclosure may result in proteins that are more readily digested.

Example 8

Digestibility Screening—Analysis of Digestion Products

Two nutritive proteins produced as described in Examples 2 and 3 (SEQ ID NOS: 762 and 763) were subjected to SGF and SIF digestion as described in Example 7. Both proteins were completely digested in SGF, and the SGF half lives are shown in Table 8.

TABLE 8

| | Digestion τ₁/₂ (min.) | |
|---|---|---|
| Seq ID No | Simulated Gastric Fluid | Simulated Intestinal Fluid |
| 486 | 0.7 | n/a |
| 493 | 6 | n/a |

To detect and identify peptides that were present after SGF and SIF digestion, samples of the SGF and SIF digests were analyzed by LC/Q-TOF MS/MS. Samples from the SGF digests were directly analyzed by LC/Q-TOF MS/MS, while SIF protein digestions required purification by SCX to remove bile acids before detection and identification by LC/Q-TOF MS/MS. Peptides were extracted from the chromatograms and identified using Bioconfirm Software (Aglient). The sequence assignment of peptides were based on accurate mass match (±10 ppm) and further confirmed by MS/MS fragmentation. The results are shown in Tables 9 and 10 below.

TABLE 9

(SEQ ID NO: 486)

| SGF Peptides 120 min | SEQ ID NO | SIF Peptides 120 min | SEQ ID NO |
|---|---|---|---|
| LL | | SE | |
| LAL | | PSE | |
| HVL | | HVL | |
| LEL | | FKV | |
| LALA | 496 | HQI | |
| LLLD | 497 | PSEA | 498 |
| IAEF | 499 | REV | |
| IQQF | 500 | FDK | |
| YDKL | 501 | AEFK | 502 |
| SNLTE | 503 | LKHV | 504 |
| ELLEA | 505 | SSSEL | 506 |
| EELAL | 507 | FKVF | 508 |
| DDLLL | 509 | AELKH | 510 |
| LAYDK | 511 | LKHVL | 512 |
| TKTRL | 513 | FKEAF | 514 |
| DLDHQ | 515 | NGSISSS | 516 |
| GTLENL | 517 | SLGLSPS | 518 |
| EKLTDA | 519 | GEKLTD | 520 |
| AEVDDM | 521 | ELATVM | 522 |
| LDDLLL | 523 | GSGEINI | 524 |
| LDLDHQ | 525 | RSLGLSP | 526 |
| DLKKKL | 527 | ELKHVL | 528 |
| KTKTRL | 529 | KLTDAEV | 530 |
| SQRLEE | 531 | FKVFDK | 532 |
| AEVDDML | 533 | AEVDDML | 534 |
| QQELDDL | 535 | DAEVDDM | 536 |
| LEKTKTR | 537 | AELKHVL | 538 |
| LEKTKTR | 539 | HVLTSIGE | 540 |
| GTLENLEE | 541 | SIGEKLTD | 542 |
| QQELDDLL | 543 | RSLGLSPSE | 544 |
| KLEKTKTRLQ | 545 | VLTSIGEKL | 546 |

TABLE 9 -continued

(SEQ ID NO: 486)

| SGF Peptides 120 min | SEQ ID NO | SIF Peptides 120 min | SEQ ID NO |
|---|---|---|---|
| SRQLKSNDSEQ | 547 | TSIGEKLTD | 548 |
| EKTKTRLQQEL | 549 | HVLTSIGEK | 550 |
| YDKLEKTKTRL | 551 | AELKHVLTS | 552 |
| LAYDKLEKTKTRL | 553 | RSLGLSPSEA | 554 |
| EELKKKLLKDLEL | 555 | SSNLTEEQIA | 556 |
| EELKKKLLKDLELL | 557 | RSLGLSPSEAE | 558 |
| AELKHVLTSIGEKLTD | 559 | KVFDKNGDGLISA | 560 |
| MGSHHHHHHHHSSNL | 561 | FDKDNNGSISSSEL | 562 |
| LREVSDGSGEINIQQF | 563 | REVSDGSGEINIQQ | 564 |
| AAELKHVLTSIGEKLTD | 565 | DVDGNHQIEFSEF | 566 |
| AELKHVLTSIGEKLTDAE | 567 | LREVSDGSGEINIQQ | 568 |
| AYDKLEKTKTRLQQEL | 569 | REVSDGSGEINIQQF | 570 |
| AAELKHVLTSIGEKLTDAE | 571 | LREVSDGSGEINIQQFAALLS | 572 |
| LENLEELKKKLLKDLEL | 573 | | |
| KLEKTKTRLQQELDDLL | 574 | | |
| DKLEKTKTRLQQELDDLL | 575 | | |
| LAYDKLEKTKTRLQQELDDL | 576 | | |
| LALAYDKLEKTKTRLQQELDDL | 577 | | |

TABLE 10

(SEQ ID NO: 491)

| SGF Peptides 120 min | SEQ ID NO | SIF Peptides 120 min | SEQ ID NO |
|---|---|---|---|
| GVL | | TKH | |
| ALL | | INDI | 578 |
| LVL | | HLVL | 579 |
| IGVL | 580 | TIKF | 581 |
| TIKF | 582 | IGVLD | 583 |
| TIKF | 584 | RNLD | 585 |
| EVYDL | 586 | IGVLDV | 587 |
| LNDSVQ | 588 | QTIKF | 589 |
| IWVIND | 590 | VQTIKF | 591 |
| DLNDSVQ | 592 | SVQTIKF | 593 |
| SVQTIKF | 594 | KCAKCISMIGVL | 595 |
| HHLVLGALLD | 596 | EKCAKCISMIGV | 597 |
| HHHHHHLVL | 598 | HEFKRTTYSE | 599 |
| HHHHHHHLVL | 600 | SHKFRNLDKDL | 601 |
| DVTKHEFKRTTY | 602 | ISMIGVLDVTKHE | 603 |
| SHHHHHHHHLVL | 604 | | |
| TKHEFKRTTYSEN | 605 | | |
| GSHHHHHHHHLVLG | 606 | | |
| MGSHHHHHHHHLVL | 607 | | |
| KRTTYSENEVYDLN | 608 | | |

As can been seen in Tables 9 and 10, each protein was digested into multiples smaller peptide fragments ranging in size from 2 to 22 amino acids (SEQ ID NO: 486) or 2 to 13 amino acids (SEQ ID NO: 491). None of these peptide fragments was found to be homologous to any known allergen.

While the present invention has been described with reference to the specific embodiments thereof, it should be understood by those skilled in the art that various changes may be made and equivalents may be substituted without departing from the true spirit and scope of the invention. In addition, many modifications may be made to adapt a particular situation, material, composition of matter, process, process step or steps, to the objective, spirit and scope of the present invention. All such modifications are intended to be within the scope of the claims appended hereto.

SEQUENCE LISTING (609 sequences)

SEQ ID NO: 1 - protein, 571 aa, Pisum sativum
MATTVKSRFPLLLFLGIIFLASVCVTYANYDEGSETRVPGQRERGRQEGEKEEKRHGEWRPSYEKEEHEEEKQKYRYQREKKEQKEVQPGRERWEREEDEEQVEEEWRGSQRREDPEERARLRHREERTKRDRRHQREGEEEERSSESQEHRNPFLFKSNKFLTLFENENGHIRRLQRFDKRSDLFENLQNYRLVEYRAKPHTIFLPQHIDADLILVVLNGKAILTVLSPNDRNSYNLERGDTIKIPAGTTSYLVNQDDEEDLRVVDFVIPVNRPGKFEAFGLSENKNQYLRGFSKNILEASLNTKYETIEKVLLEEQEKKPQQLRDRKRTQQGEERDAIIKVSREQIEELRKLAKSSSKKSLPSEFEPFNLRSHKPEYSNKFGKLFEITPEKKYPQLQDLDILVSCVEINKGALMLPHYNSRAIVVLLVNEGKGNLELLGLKNEQQEREDRKERNNEVQRYEARLSPGDVVIIPAGHPVAISASSNLNLLGFGINAKNNQRNFLSGSDDNVISQIENPVKELTFPGSSQEVNRLIKNQKQSHFASAEPEQKEEESQRKRSPLSSVLDSFY

SEQ ID NO: 2 - protein, 546 aa, Glycine max
MGERKGIPMALGLLAMILFFIASSSSHLVRASDDADDAIFYESFDEDFDGRWIVSDKEDYNGVWKHAKSDGHDDYGLLVSEQARKYAIVKELAESVSLKDGTVVLQFETRLQNGLECGGAYIKYLRPQESGWKPKEFDNESPYSIMFGPDKCGATNKVHFIFKHKNPKSGEYVEHHLKYPPSVPSDKLTHVYTAILKPDNELQILIDGEEKKKANFLSSEDFEPPLIPSKTIPDPDDKKPEDWDERAKIPDPSAVKPDDWDEDAPMEILDEEAEKPEGWLDDEPEEIDDPEATKPEDWDDEEDGEWEAPKIENPKCEAAPGCGEWKRPTKRNPAYKGKWSAPYIDNPSYKGIWKPREIPNPEYFELAKPDFEPIAAIGIEIWTMQDGILFDNVLIANDDKVAESYRETTWKPKFTVEKDKLKAEEEAATGSDGISGFQKKVFDLLYKIADIPFLSEHKSKIFDLIEKAEKQPNLTIGILVAVVVVFVSIFFRLIFGGKKPAKVEKKPERTEASNNQGSGENEENKEKEKQKEEASNAARRRPRRET

SEQ ID NO: 3 - protein, 551 aa, Pisum sativum
MVDRKEIPLAMGLLAVLLFFVASSSSFHLVRASDEVDDAIFYESFDEDFDNRWIVSGKEEYNGVWKHSKSEGHDDFGLLVSEPARKYAIVKELDAPVSLKDGTVVLQFETRLQNGLECGGAYIKYLQTQESGWKPKGFDNESGYSIMFGPDRCGATNKVHFIFRHKNPKTGKHVEHHLKFPPSVPSDKLSHVYTAVLKDDNEVSILIDGEEKKKANFLSSEDFEPALIPSKTIPDPDDKKPEDWDERAKIPDPEAVKPEDWDEDAPREIIDEEAEKPEPWLDHEPEVDDPEAKPEDWDDEEDGEWEAPKIENPKCEAAPGCGEWKRPTKSNPAYKGKWSAPYIDNPNYKGIWKPQEIPNPEYFELEKPDFEPIAAIGIEIWTMQDGILFDNVLIAKDDKIAESYRETTWKPKFNIEKEKQKHEEEAAAAAAARSESEGIAGIQKKAFDLLYKIADIAFLSGQKEKIIEIIEKGEKQPNLTIGIIVSVVIVFVSIFFRLIFGGKKPANVEANVEKKKTNTETTSKQDGGEKEDNKEKEETANPPRRRPKRDN

SEQ ID NO: 4 - protein, 192 aa, Glycine max
MRLQQLNLFFLLLCVAKANGSLLPFMDPPITLLADLWSDRFPDPFRVLEHIPFGVDKDEASMAMSPARVDWKETPEGHVIMLDVPGLKREEIKVEVEENRVLRVSGERKKEEEKKGDHWHRVERSYGKFWRQFRLPQNVDLDSVKAKLENGVLTLTLDKLSPGKIKGPRVVSIAGEDHQQGNLNNDGAKQEL

SEQ ID NO: 5 - protein, 804 aa, Sus scrofa
MRALWVLGLCCVLLTFGSVRAEDEVDVDGTVEEDLGKSREGSRTDDEVVQREEEAIQLDGLNASQIRELREKSEKFAFQAEVNRMMKLIINSLYKNKEIFLRELISNASDALDKIRLISLTDENALAGNEELTVKIKCDKEKNLLHVTDTGVGMTREELVKNLGTIAKSGTSEFLNKMAEAQEDGQSTSELIGQFGVGFYSAFLVADKVIVTSKHNNDTQHIWESDSNEFSVIADPRGNTLGRGTTITLVLKEEASDYLELDTIKNLVKKYSQFINFPIYVWSSKTETVEEPMEEEEAAKEEKEESDDEAAVEEEEEEKKPKTKKVEKTVWDWELMNDIKPIWQRPSKEVEDDEYKAFYKSFSKESDDPMAYIHFTAEGEVTFKSILFVPTSAPRGLFDEYGSKKSDYIKLYVRRVFITDDFHDMMPKYLNFVKGVVDSDDLPLNVSRETLQQHKLLKVIRKKLVRKTLDMIKKIADEKYNDTFWKEFGTNIKLGVIEDHSNRTRLAKLLRFQSSHHPSDITSLDQYVERMKEKQDKIYFMAGSSRKEAESSPFVERLLKKGYEVIYLTEPVDEYCIQALPEFDGKRFQNVAKEGVKFDESEKSKENREAVEKEFEPLLNWMKDKALKDKIEKAVVSQRLTESPCALVASQYGWSGNMERIMKAQAYQTGKDISTNYYASQKKTFEINPRHPLIRDMLRRVKEDEDDKTVSDLAVVLFETATLRSGYLLPDTKAYGDRIERMLRLSLNIDPDAKVEEEPEEEPEETTEDTTEDTEQDDDEEMDAGADEEEQETSETSTAEKDEL

SEQ ID NO: 6 - protein, 197 aa, Pisum sativum
MSLKPLNMLLVPFLLLILAADFPLKAKASLLPFIDSPNTLLSDLWSDRFPDPFRVLEQIPYGVEKHEPSITLSHARVDWKETPEGHVIMVDVPGLKKDDIKIEVEENRVLRVSGERKKEEDKKGDHWHRVERSYGKFWRQFKLPQNVDLDSVKAKMENGVLTLTLHKLSHDKIKGPRMVSIVEEDDKPSKIVNDELK

SEQ ID NO: 7 - protein, 1939 aa, Sus scrofa
MSSDQEMAIFGEAAPYLRKSEKERIEAQNKPFDAKTSVFVAEPKESFVKGTVQSREGGKVTVKTEAGATLTVKEDQVFPMNPPKFDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEPTSGKMQGTLEDQIISANPLLEAFGNAKTVRNDNSSRFGKFIRIHFGTTGKLASADIETYLLEKSRVTFQLKAERSYHIFYQIMSNKKPELIEMLLITTNPYDYAFVSQGEITVPSIDDQEELMATDSAIEILGFTSDERVSIYKLTGAVMHYGNLKFKQKQREEQAEPDGTEVADKAAYLQGLNSADLLKALCYPRVKVGNEFVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKVEAHFSLIHYAGTVDYNITGWLDKNKDPLNETVVGLYQKSSVKTLAFLFTGAAGADAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQARCRGFLARVEYQKMVERRESIFCIQYNIRAFMNVKHWPWMKLYFKIKPLLKSAETEKEMANMKEEFEKTKESLAKAEAKRKELEEKMVALMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRTLEDQLSELKTKEEEQQRLINDLTAQRARLQTESGEYSRQLDEKDTLVSQLSRGKQAFTQQIEELKRQLEEEIKAKSALAHAVQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERSNAACAALDKKQRNFDKILAEWKQKYEETHAELEASQKESRSLSTELFKVKNAYEESLDQLETLKRENKNLQQEISDLTEQIAEGGKRIHELEKIKKQVEQEKSEIQAALEEAEASLEHEEGKILRIQLELNQVKSEVDRKIAEKDEEIDQLKRNHVRVVESMQSMLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKVAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVETVKGLRKHERRVKELTYQTEEDRKNILRLQDLVDKLQAKVKSYKRQAEEAEEQSNVNLSKFRKLQHELEEAEERADIAESQVNKLRVKSREVHTKIISEE

SEQ ID NO: 8 - protein, 1939 aa, Sus scrofa
MSSDQEMAIFGEAAPYLRKSEKERIEAQNRPFDAKTSVFVAEPKESFVKGTIQSREGGKVTVKTEAGATLTVKEDQVFPMNPPKFDKIEDMAMMTHLHEPGVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPTSGKMQGTLEDQIISANPLLEAFGNAKTVRNDNSSRFGKFIRIHFGTTGKLASADIETYLLEKSRVTFQLKAERSYHIFYQITSNRKPELIEMLLITTNPYDYPFISQGEISVASIDDQEELIATDSAIDILGFTNEEKVSIYKLTGAVMHYGNLKFKQKQREEQAEPDGTEVADKAAYLQSLNSADLLKALCYPRVKVGNEYVTKGQTVEQVTNAVGALAKAVYEKMFLWMVTRINQQLDTKQPRQYFIGVLDIAGFEIFDFNSLEQLCINFTNEKLQQFFNHHMFVLEQEEYKREGIEWTFIDFGMDLAACIELIEKPMGIFSILEEECMFPKATDTSFKNKLYEQHLGKSANFQKPKPAKGKVEAHFSLIHYAGTVDYNITGWLDKNKDPLNDTVVGLYQKSALKTLAFLFSGAQTGEAEAGGTKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQYIDSKKASEKLLASIDIDHTQYKFGHTKVFFKAGLLGLLEEMRDDKLAQLITRTQARCRGFLARVEYQKMVERRESIFCIQYNIRAFMNVKHWPWMKLFFKIKPLLKSAESEKEMATMKEEFQKTKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKTKLEQQVDDLEGSLEQEKKLRMDLERAKRKLEGDLKLAQESIMDIENEKQQLDEKLKKKEFEISNLQSKIEDEQALAIQLQKKIKELQARIEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSEMKMEIDDLASNMETVSKAKGNLEKMCRTLEDQLSELKSKEEEQQRLINDLTAQRGRLQTESGEFSRQLDEKEALVSQLSRGKQAYTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKYEETHAELEASQKEARSLGTELFKMKNAYEESLDQLETLKRENKNLQQEISDLTEQIAEGGKRIHELEKIKKQVEQEKSEIQAALEEAEASLEHEEGKILRIQLELNQVKSEVDRKIAEKDEEIDQLKRNHVRVVESMQSMLDAEIRSRNDAIRLKKKMEGDLNEMEIQLNHANRMAAEALRNYRNTQGILKDTQIHLDDALRGQEDLKEQLAMVERRANLLQAEIEELRATLEQTERSRKVAEQELLDASERVQLLHTQNTSLINTKKKLETDISQMQGEMEDILQEARNAEEKAKKAITDAAMMAEELKKEQDTSAHLERMKKNMEQTVKDLQHRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLSKFRKLQHELEEAEERADIAESQVNKLRVKSREVHTKVISEE

SEQ ID NO: 9 - protein, 573 aa, Zea mays
MVSARIVVLLAVLLCAAAAVASSWEDDNHHHHGGHKSGRCVRRCEDRPWHQRPRCLEQCREEEREKRQERSRHEADDRSGEGSSEDEREREQEKEEKQKDRRPYVFDRRSFRRVVRSEQGSLRVLRPFDEVSRLLRGIRDYRVAVLEANPRSFVVPSHTDAHCIGYVAEGEGVVTTIENGERRSYTIKQGHVFVAPAGAVTYLANTDGRKKLVITKILHTISVPGEFQFFFGPGGRNPESFLSSFSKSIQRAAYKTSSDRLERLFGRHGQDKGIIVRATEEQTRELRRHASEGGHGPHWPLPPFGESRGPYSLLDQRPSIANQHGQLYEADARSFHDLAEHDVSVSFANITAGSMSAPLYNTRSFKIAYVPNGKGYAEIVCPHRQSQGGESERERGKGRRSEEEEESSEEQEEVGQGYHTIRARLSPGTAFVVPAGHPFVAVASRDSNLQIVCFEVHADRNEKVFLAGADNVLQKLDRVAKALSFASKAEEVDEVLGSRREKGFLPGPKESGGHEEREQEEEEREERHGGRGERERHGREEREKEEEEREGRHGRGRREEVAETLLRMVTARM

SEQ ID NO: 10 - protein, 1937 aa, Sus scrofa
MSSDQEMAIFGEAAPYLRKSEKERIEAQNKPFDAKTSVFVAEPKESFVKGTVQSREGGKVTVKTEAGATLTVKEDQVFPMNPPKFDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEPTPGKMQGTLEDQIISANPLLEAFGNAKTVRNDNSSRFGKFIRIHFGTTGKLASADIETYLLEKSRVTFQLKAERSYHIFYQIMSNKKPELIEMLLITTNPYDYAFVSQGEITVPSIDDQEELMATDSAIEILGFTSDERVSIYKLTGAVMHYGNLKFKQKQREEQAEPDGTEVADKAAYLQGLNSADLLKALCYPRVKVGNEFVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKAEAHFSLIHYAGTVDYNITGWLDKNKDPLNETVVGLYQKSSVKTLAFLFAERQSSEEGGTKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGTLEEMRDEKLAQLITRTQAMCRGFLMRVEFRKMMERRESIFCIQYNIRAFMNVKHWPWMKLYFKIKPLLKSAETEKEMANMKEEFEKTKEDLAKSEAKRKELEEKMVALMQEKNDLQLQVQAEADGLADAEERCDQLIKTKIQLEAKIKEVTERAEDEEEINAELTAKKRKLEDECSELKKDIDDLELTLAKVEKEKHATENKVKNLTEEMAGLDENIAKLTKEKKALQEAHQQTLDDLQAEEDKVNTLTKAKTKLEQQVDDLEGSLEQEKKLRMDLERAKRKLEGDLKLAQESTMDIENDKQQLDEKLKKKEFEMSNLQSKIEDEQALAMQLQKKIKELQARTEELEEEIEAERASRAKAEKQRSDLSRELEEISERLEEAGGATSAQIEMNKKREAEFQKMRRDLEEATLQHEATAAALRKKHADSVAELGEQIDNLQRVKQKLEKEKSELKMEIDDLASNMETVSKAKGNLEKMCRTLEDQLSEVKTKEEEHQRLINELSAQKARLQTESGEFSRQLDEKEALVSQLSRGKQAFTQQIEELKRQLEEETKAKSALAHAVQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMLDVERSNAACAALDKKQRNFDKILAEWKHKYEETQAELEASQKESRSLSTELFKVKNAYEESLDQLETLKRENKNLQQEISDLTEQIAEGGKHIHELEKVKKQIEQEKSELQAALEEAEASLEHEEGKILRIQLELNQVKSEIDRKIAEKDEEIDQMKRNHIRVVESMQSTLDAEIRSRNDALRIKKKMEGDLNEMEIQLNHANRQATEAIRNLRNTQGVLKDTQLHLDDAIRGQDDLKEQLAMVERRANLMQAEIEELRASLEQTERSRRVAEQELLDASERVQLLHTQNTSLINTKKKLETDISQIQGEMEDIVQEARNAEEKAKKAITDAAMMAEELKKEQDTSAHLERMKKNMEQTVKDLQHRLDEAEQLALKGGKKQIQKLEARVRELENEVENEQKRNVEAVKGLRKHERRVKELTYQTEEDRKNVLRLQDLVDKLQSKVKAYKRQAEEAEEQSNVNLSKFRKLQHELEEAEERADIAESQVNKLRVKSREVHTKVISEE

SEQ ID NO: 11 - protein, 420 aa, Zea mays
MAIRKGSSYAVAALLALASVAAVAGEVFFQEKFEDGWESRWVKSEWKKDENMAGEWNHTSGKWNGDAEDKGIQTSEDYRFYAISAEYPEFSNKDKTLVLQFSVKHEQKLDCGGGYVKLLGGDVDQKTLGGDTSYSIISRPDISRYSTKKVHTILTKDGKNHLIKKDVPCQTDQLTHVYTFIIRPDATYSILIDNEEKHTGSIYEHWDILPPKKIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNIIITDDPALAKTFAEETWGKHKEAEKAAFDEAEKKKEEEDAAKGGDDEDDDLEDEEDDEKADEDKADSDAEDGKDSDDEKHDEL

SEQ ID NO: 12 - protein, 424 aa, Oryza sativa
MAIRARSSSYAAAAVALALALASVAAVAGEVFFQEKFEDGWESRWVKSEWKKDENMAGEWNHTSGKWNGDPEDKGIQTSEDYRFYAISAEYPEFSNKDKTLVLQFSVKHEQKLDCGGGYVKLLGGDVDQKKFGGDTPYSIMFGPDICGYSTKKVHTIFTKNDKNHLIKKDVPCETDQLSHVYTLIIHPDATYTILIDNVEKQSGSIYEHWDILPPKQIKDPEAKKPEDWDDKEYIPDPEDKKPEGYDDIPKEIPDPDAKKPEDWDDEEDGEWTAPTIPNPEYKGPWKQKKIKNPNYQGKWKAPMIDNPDFKDDPYIYAFDSLKYIGIELWQVKSGTLFDNFLITDDPELAKTFAEETWGKHKDAEKAAFDEAEKKKEEEEAAKAGEDDDDLDDEDAEDEDKADEKADSDAEDGKDSDDEKHDEL

SEQ ID NO: 13 - protein, 132 aa, Sus scrofa
MSNKFLGTWKLVSSENFDDYMKALGVGLATRKLGNLAKPRVIISKKGDIITIRTESTFKNTEISFKLGQEFEETTADNRKAKSVVTLARGSLNQVQKWDGKETTIKRKLVDGKMVVECKMKDVVCTRIYEKV

SEQ ID NO: 14 - protein, 149 aa, Ovis aries [sequence omitted]

SEQ ID NO: 15 - protein, 1935 aa, Sus scrofa
MVDAEMAAFGEAAPYLRKSEKERLEAQTRPFDLKKDVYVPDDKEEFVKAKILSREGGKVTAETEHGKTVTVKEDQVLQQNPPKFDKIEDMAMLTFLHEPAVLYNLKERYASWMIYTYSGLFCVTINPYKWLPVYNAEVVAAYRGKKRSEAPPHIFSISDNAYQYMLTDRENQSILITGESGAGKTVNTKRVIQYFAVIAAIGDRSKKEQTPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVMYATGALAKAVYEKMFNWMVTRINTTLETKQPRQYFIGVLDIAGFEIFDFNSFEQLCINFTNEKLQQFFNHHMFVLEQEEYKKEGIEWEFIDFGMDLQACIDLIEKPMGIMSILEEECMFPKATDMTFKAKLYDNHLGKSNNFQKPRNIKGRPEAHFALIHYAGTVDYNIIGWLQKNKDPLNETVVDLYKKSSLKLLSNLFANYAGADTPVEKGKGKAKKGSSFQTVSALHRENLNKLMTNLRSTHPHFVRCIIPNETKSPGVIDNPLVMHQLRCNGVLEGIRICRKGFPNRILYGDFRQRYRILNPAAIPEGQFIDSRKGAEKLLGSLDIDHNQYKFGHTKVFFKAGLLGLLEEMRDERLSRIITRIQAQSRGVLSRMEFKKLLERRDSLLIIQWNIRAFMSVKNWPWMKLYFKIKPLLKSAETEKEMATMKEEFGRLKEALEKSEARRKELEEKMVSLLQEKNDLQLQVQAEQDNLADAEERCDQLIKNKIQLEAKVKEMTERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQHVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKLELQSALEEAEASLEHEEGKILRAQLEFNQIKAEMERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMEADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 16 - protein, 154 aa, Zea mays
MDARMFGLETPRVAALHHLLDVPDGDKAGGGATRTYVRDARAMAATPADVKELAGAYAFVVDMPGLSTGDIRVQVEDERVLVISGERRREEREDAKYLRMERRMGKFMRKFVLPDNADVDKVAAVCRDGVLTVTVEKLPPPEPKKPKTIEIKVA

SEQ ID NO: 17 - protein, 549 aa, Sus scrofa
MSSFYSEPYYSTSYKRRYVETPRVHISSVRSGYSTARSAYSSYSAPVSSSLSVRRSYSSSSGLMPSLENLDLSQVAAISNDLKSIRTQEKAQLQDLNDRFASFIERVHELEQQNKVLEAQLLVLRQKHSEPSRFRALYEQEIRDLRLAAEDATNEKQALQGEREGLEETLRNLQARYEEEVLSREDAEGRLMEARKGADEAALARAELEKRIDSLMDEIAFLKKVHEEEIAELQAQIQYAQISVEMDVSSKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSLTTGYSQSSQVFGRSAYGGLQTSSYLMSTRSFPSYYTSHVQEEQIEVEETIEAAKAEEAKDEPPSEGEAEEEGKEKEEAEAEAEAEEEGAQEEEEAAEKEESEEAKEEEGGEGEQGEETKEAEEEEKKDEGAGEEQATKKKD

SEQ ID NO: 18 - protein, 175 aa, Oryza sativa
MELSVVGGEPLLAVAMQQLLDLDLPDELERQLNPPTRAYVRDRRAMANTPMDVKELRASGALVLAVDMPGVAPADVRVEVEDGNVLAISGERRRPAGDGDDGGEGVKYLRMERRMGKFMRRFPLPESADLDGVRAEYKDGVLTVTVDKKPPPEPKKPRVVEVKVAGAGEPKGKGK

SEQ ID NO: 19 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 20 - protein, 158 aa, Oryza sativa
MPMAELEQVFRRYDANGDGKISAEELASVLRALGAPLGPGEVRRMMDEMDSDRDGFVDLSEFAAFHCGPTPAHGGKGGDAKDQEAASEAELREAFRMYDADSNGKISARELHRVLRQLGDKCSVADCSRMIRSVDADGDGCVNFDEFKKMMGGGGGRR

SEQ ID NO: 21 - protein, 183 aa, Oryza sativa
MDHLTKEQIAEFREAFNLFDKDGDGTITSKELGTVMGSLGQSPTEAELKKMVEEVDADGSGSIEFEEFLGLLARKLRDTGAEDDIREAFRVFDKDQNGFITPDELRHVMANLGDPLSDDELADMLHEADSDGDGQINYNEFLKVMMAKRRQNMMEGHGSGGHRSSNSHKKSGCCGPNSSCTIL

SEQ ID NO: 22 - protein, 149 aa, Glycine max; identical to SEQ ID NO: 19

SEQ ID NO: 23 - protein, 149 aa, Spinacia oleracea
MAZZLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYEEFVKVMMAK

SEQ ID NO: 24 - protein, 149 aa, Oryza sativa; identical to SEQ ID NO: 19

SEQ ID NO: 25 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 26 - protein, 149 aa, Capsicum annuum
MADQLTDDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 27 - protein, 149 aa, Solanum tuberosum
MADQLTEDQISEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREADVDGDGQINYDEFVKVMMAK

SEQ ID NO: 28 - protein, 149 aa, Agaricus bisporus
MADQLSEEQISEFKEAFSLFDKDGDGTITTKELGTVMRSLGQNPSQAELEDMINEVDADGNGTIDFPEFLTMMARKMRDTDSEEEIKEAFKVFDKDGNGYISAAELRHVMTNLGEKLTDSEVDEMIREADVDGDGQINYEEFVKMMLSK

SEQ ID NO: 29 - protein, 164 aa, Zea mays
MDAVMFGLETPLMAALQHLLDVPDGDAGAGGDNKTGSGGSATRTYVRDARAMAATPADVKELPGAYAFVVDMPGLGTGDIRVQVEDERVLVVSGERRREEREDDAKYLRMERRMGKFMRKFVLPDNADVDKVAAVCRDGVLTVTVEKLPPPEPKKPKTIEVKVA

SEQ ID NO: 30 - protein, 181 aa, Oryza sativa
MSNTTEKKMPQQQQVERPTALAPADAEIERVFTRFDADGDGRISPSELAAVTRAIAPPPSESAGGREVAAMMNELDTDRDGFVDLGEFAAFHGRGRGDAEHEAELRAAFDVYDVDGDGRITAAELGKVLGRIGEGCSAEECERMIASVDVDGDGCVGFEEFKKMMCRDAAATGGADKAKTE

SEQ ID NO: 31 - protein, 317 aa, Oryza sativa
MATAGASSFEDEIMESDIELEGEAVEPDNDPPQKMGDPSVEVSDEKRDQAQLCKNKGVDAFSEGKLDEAIEHLTEAIVLNPTSAIAYATRAVIFVKSKKPNAAIRDADAALKINPDSAKGYKSRGMAKAMLGKWEEAAQDLRMAAKLDYDEEIGAELKKVEPNVLKIEEHRKKYERLRKERDIKKAEMEKQRKHAEEVSAASAALKDGDVIAIHSSSELDTKLKAASSLSRLVVLYFTAAWCGPCRFIGPVCKSLAEKHRNVVFLKVDIDELNSVAYRWNVSSVPSFFFVRNGKEIDKVVGADKNGLERKVAQHGSS

SEQ ID NO: 32 - protein, 172 aa, Sus scrofa
MSSKRAKAKTTKKRPQRATSNVFAMFDQSQIQEFKEAFNMIDQNRDGFIDKEDLHDMLASLGKNPTDEYLEGMMSEAPGPINFTMFLTMFGEKLNGTDPEDVIRNAFACFDEEASGFIHEDHLRELLTTMGDRFTDEEVDEMYREAPIDKKGNFNYVEFTRILKHGAKDKDD

SEQ ID NO: 33 - protein, 149 aa, Zea mays
MADQLTDEQIAEFKEAFSLFDKDGDGCITTKELGTVMRSLGQNPTEAELQDMINEVDADGNGTIDFPELLNLMARKMKDTDSEEELKEAFRVFDKDQNGFISAAELRHVMTNLGEKLTDEEVDEMIREADVDGDGQINYEEFVKVMMAK

SEQ ID NO: 34 - protein, 161 aa, Zea mays
MDGRMFGLETPLMVALQHLLDVPDGDAGAGGDKAGGGGPTRTYVADARAMAVTPADVKELPGAYAFVVDMPGLGTGDIKVQVEDERVLVISGERRREEREDAKYLRMERRMGKFMRKFVLPDNADMDKISAVCRDGVLTVTVEKLPPPEPKKPKTIEVKVA

SEQ ID NO: 35 - protein, 149 aa, Oryza sativa
MADQLTDEQIAEFKEAFSLFDKDGDGCITTKELGTVMRSLGQNPTEAELQDMINEVDADGNGTIDFPEFLNLMAKKMKDTDSEEELKEAFRVFDKDQNGFISAAELRHVMTNLGEKLTDEEVDEMIREADVDGDGQINYEEFVKVMMAK

SEQ ID NO: 36 - protein, 149 aa, Oryza sativa
MADQLTDDQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTDEEVEEMIREADVDGDGQINYDEFVKVMMAK

SEQ ID NO: 37 - protein, 183 aa, Oryza sativa
MDHLTKEQIAEFREAFNLFDKDGDGTITSKELGTVMGSLGQSPTEAELKKMVEEVDADGSGSIEFEEFLGLLARKLRDTGAEDDIRDAFRVFDKDQNGFITPDELRHVMANLSDPLSDDELADMLHEADSDGDGQINYNEFLKVMMAKRRQNMMEGHGSGGHRSSNSHKKSGCCGPNSSCTIL

SEQ ID NO: 38 - protein, 149 aa, Oryza sativa; identical to SEQ ID NO: 35

SEQ ID NO: 39 - protein, 187 aa, Oryza sativa
MADQLSEEQIVEFREAFSLFDKDGDGSITTKELGTVMRSLGQNPTEAELQDMISEVDADSNGNIEFKEFLGLMARKLRDKDSEEELKEAFRVFDKDQNGFISAAELRHVMANIGERLTDEEVGEMISEADVDGDGQINYEEFVKCMMAKKRRKRIEEKREHDGGSRTKSAGPSAAPASKRGQKCVIL

SEQ ID NO: 40 - protein, 149 aa, Triticum aestivum
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQDGFISAAELRHVMTNLGEKLTDEEVDEMIREADVDGDGQINYEEFVKVMMAK

SEQ ID NO: 41 - protein, 149 aa, Malus domestica
MADQLTDDQISEFKEAFSLFDKDGDGCITTKELGTVMRSLGQNPTEAELQDMINEVDADGNGTIDFPEPLNLMARKMKDTDSEEELKEAFRVFDKDQNGFISAAELRHVMTNLGEKLTDEEVDEMIREADVDGDGQINYEEFVKVMMAK

SEQ ID NO: 42 - protein, 149 aa, Solanum lycopersicum
MAEQLTEEQIAEFKEAFSLFDKDGDGCITTKELGTVMRSLGQNPTEAELQDMISEVDADQNGTIDFPEFLNLMARKMKDTDSEEELKEAFKVFDKDQNGFISAAELRHVMTNLGEKLTDEEVDEMIREADIDGDGQVNYEEFVRMMLAK

SEQ ID NO: 43 - protein, 187 aa, Oryza sativa
MADQLSEEQIGEFREAFSLFDKDGDGSITTKELGTVMRSLGQNPTEAELQDMISEVDTDSNGNIEFKEFLGLMARKLRDKDSEEELKEAFRVFDKDQNGFISATELRHVMANIGERLTDEEVGEMISEADVDGDGQINYEEFVKCMMAKKRRKRIEEKRDHDGGSRTKSAGPSAAPASKRGQKCVIL

SEQ ID NO: 44 - protein, 149 aa, Solanum tuberosum
MAEQLTEEQIAEFKEAFSLFDKDGDGCITTKELGTVMRSLGQNPTEAELQDMISEADADQNGTIDFPEFLNLMARKMKDTDSEEELKEAFKVFDKDQNGFISAAELRHVMTNLGEKLTDEEVDEMIREADIDGDGQVNYEEFVRMMLAK

SEQ ID NO: 45 - protein, 162 aa, Meleagris gallopavo
PSMTDQQAEARAFLSEEMIAEFKAAFDMFDADGGGDISTKELGTVMRMLGQNPTKEELDAIIEEVDEDGSGTIDFEEFLVMMVRQMKEDAKGKSEEELANCFRIFDKNADGFIDIEELGEILRATGEHVTEEEIEDLMKDSDKNNDGRIDFDEFLKMMEGVQ

SEQ ID NO: 46 - protein, 202 aa, Pisum sativum
MASSLALKRFLSSGLLSSSFLRPVASSASRSFNTNAMRQYDQHSDDRNVDVYRHSFPRTRRDDLLLSDVFDPFSPPRSLSQVLNMVDLLTDNPVLSAASRRGWDARETEDALFLRLDMPGLGKEDVKISVEQNTLTIKGEEGAKESEEKEKSGRRFSSRIDLPEKLYKIDVIKAEMKNGVLKVTVPKMKEEERNNVINVKVD

SEQ ID NO: 47 - protein, 154 aa, Oryza sativa
MEGLTSEQMVAFQEAFLLFDKNGDGCITLEELAAVTRSLGLEPTDQELNDMMREVDTDGNGIIDFQEFLSLIARKMKDGDGDEELKEAFEVLDKDQNGFISPTELRTVMTNLGEKMTDEEVEQMIREADTDGDGQVNYDEFVIMMKNAERKISG

SEQ ID NO: 48 - protein, 170 aa, Oryza sativa
MESHLNEQQISDFRDAFSLFDKNNDGCISREELATVLTRLGMAPSQEDLQDMIVAVDEDGNGTIEFDEFLAIMKKKLYENDKGDDEEELRKAFRIFDKDDNGFISRNELSMVMASLGEEMTEDEIDDMMKAADSNNDGQVDYEEFKRVMMSTWNITEIFKPHVTIWRYKP

SEQ ID NO: 49 - protein, 471 aa, Sus scrofa
MSQAYSSSQRVSSYRRTFGGAPSFPLGSPLSSPVFPRAGFGTKGSSSSVTSRVYQVSRTSGGAGGLGPLRASRLGATRVPSSSYGAGELLDFSLADAVNQEFLTTRTNEKVELQELNDRFANYIEKVRFLEQQNAALAAEVNRLKGREPTRVAEIYEEELRELRRQVEVLTNQRARVDVERDNLLDDLQRLKAKLQEEIQLKEEAENNLAAFRADVDAATLARIDLERRIESLNEEIAFLKKVHEEEIRELQAQLQEQQVQVEMDMSKPDLTAALRDIRAQYETIAAKNISEAEEWYKSKVSDLTQAANKNNDALRQAKQEMMEYRHQIQSYTCEIDALKGTNDSLMRQMRELEDRFASEASGYQDNIARLEEEIRHLKDEMARHLREYQDLLNVKMALDVEIATYRKLLEGEESRINLPIQTFSALNFRETSPEQRGSEVHTKKTVMIKTIETRDGEVVSEATQQQHEVL

SEQ ID NO: 50 - protein, 159 aa, Sus scrofa
TDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNMDGYIDAEELAEIFRASGEHVTDEEIESIMKDGDKNNDGRIDFDEFLKMMEGVQ

SEQ ID NO: 51 - protein, 172 aa, Oryza sativa
MDSTELRKVFKMFDKNGDGRITKKELGESFKNFGIFIPDDELDATMDKIDANGDGCVDVEEFGLLYRSILGDDAAGRAPRTAAAAIGGEGGAPDDEDEGMREAFNVFDQNGDGFITVDELRSVLSSLGLKHGRTADDCRRMISMVDADGDGRVDFKEFKQMMRGGGFAALGG

SEQ ID NO: 52 - protein, 204 aa, Oryza sativa
MTSVWKTKVLTGLNKLFDKDGKKAAAAEFLKSFNKEEIGKEIDDKKTELEPKVVEVVESSPPEIKALLKDKKTASKIKKNGPAVTKFLEELAKIDFPGAKPVSDAVAKSGTTPLSPAIAFILEKVAPFVPKEEPKPEPEAEAAAETTSREVAVEEEKKEEEAAPAEPAAAAAEAAAPSTEVVEEKKEEEKPAEAAAPAAEPEKQ

SEQ ID NO: 53 - protein, 204 aa, Oryza sativa; identical to SEQ ID NO: 52

SEQ ID NO: 54 - protein, 151 aa, Oryza sativa
MVASDEFRRVFGSFDQDGDGKISATELRLCVKASLGEDMPDEEVQALMALADTDGDGLLDEEEFVRLVTEMEADGDEEEDDDDETCRCLREAFAMYEMEGRGCITPLSLKLMLSKLGTHLDVAECQAMICRFDMNGDGVLTFDEFKTMMMA

SEQ ID NO: 55 - protein, 151 aa, Oryza sativa
MVVASAASPCESSALFATFDHDGDGRISAAELRLCMKTTLGEEVSDEEAGQLVASVDADGDGLLCEAEFVRLVQAAEVEEEDERRGTGLREAFGMYEMEGEGCITPTSLRRMLRRLGSDQDIDDCRAMICRFDLNGDGVLSFDEFKIMMNA

SEQ ID NO: 56 - protein, 166 aa, Oryza sativa
MAEVEVRVRQEQVAEFRETFAFFDKDGDGCITLEELDTVVRSLGQTPTREELAEMIRDVDVDGNGTIEFAEFLALMARKASRGGENGGGGDDSGDAADEELREAFKVFDKDQDGLISAAELRHVMISLGEKLTDEEVEQMIREADLDGDGQVNFDEFVRMMMLSDQ

SEQ ID NO: 57 - protein, 164 aa, Oryza sativa
MSLVLSRMLLDRFFPGAGGVVAGEARPPMDWRETPVAHVFEMDLPGLAKDQVAVEVVDGHILRVRAGGEHEDANNAAKAGKASGEEEEENDGVRWHCRERAAGRRRAAVTQFRLPEDAAADEASARMADGVLTVTVPKRKGKKRHAGNGKAAGDDKPVCCRFWP

SEQ ID NO: 58 - protein, 262 aa, Triticum aestivum
MEDERSTQSYQGGEAAEQVEVTDRGLLGNLLGKKKAEEDKEKEEELVTGMEKVSVEEPEVKKEEHEDGEKKETLFSKLHRSSSSSSSSSDEEEEEVIDDNGEVIKRKKKKGLKEKLQGKLPGHKDTEGEHVTGLPAPAAPASVQTHGGHHDTDVVVEKIDGDVKTEAAPAVPEEEKKGFLEKIKEKLPGGHKKPEDAAAVPVTHAAPAPVHAPVPAPEEVSSPDAKEKKGLLGKIMDKLPGYHKTGEEDKAAAATGEHKPSA

SEQ ID NO: 59 - protein, 261 aa, Ovis aries
MDMKRRIHLELRNRTPAAVRELVLDNCKSNDGKIEGLTAEFVNLEFLSLINVGLISVSNLPKLPKLKKLELSDNRICGGLDMLAEKLPNLTHLNLSGNKLKDIGTLEPLKKLECLKSLDLFNCEVTNLNDYRESVFKLLPQLTYLDGYDREDREAPDSDAEVDGVDEEEDDEEGENEDKEEDEDGEEEEFDDEEDDDEDEDVEGEEDEDKVSGEEEEFGHDGEADEDDEDEDEDEDEDEEEEESGKGEGRKRETDDEGEDD

SEQ ID NO: 60 - protein, 272 aa, Oryza sativa
MADAAAPGEDDAAWERAIAAAVKNAPFSAPKTLTLDGAVKSTTGRLPSPSLLGRYPSLEELSVAGARLSSLAGLPRLPALRRLSLPDNRLSGAASLAAVAESCGATLRHLDLGNNRFADVAELAPLAPHGVESLDLYQCPVTKAKGYRDKVFALIPSLKFLDGMDAEGNDCLDSDDEEDEEEDEGEEGEGEGDEEEEEEGGEEGEGDEDDEEEGDEEEDEEEGEEEAEDEEDEAGADEEDESKVANGSKGSSGSAQPNKRKRDSEDDANGDN

SEQ ID NO: 61 - protein, 211 aa, Glycine max
MASSLIAKRFLSSSLLSRSLLRPAASASHRSFDTNAMRQYDNRADDHSTDIDRHSERSFPSTARRDDIFLRCVGSIFSDSEFEPGSEHDGPGHGQSVPLRVARDRSWRWSGRGWDARETEDALHLRVDMPGLAKEDVKISVEQNTLIIKGEGAKEGDEEESARRYTSRIDLPDKLYKIDQIRAEMKNGVLKVVVPKMKEEERKDVISVKVE

SEQ ID NO: 62 - protein, 161 aa, Sus scrofa
MDDIYKAAVEQLTEEQKNEFKAAFDIFVLGAEDGCISTKELGKVMRMLGQNPTPEELQEMIDEVDEDGSGTVDFDEFLVMMVRCMKDDSKGKSEEELSDLFRMFDKNADGYIDLEELKIMLQATGETITEDDIEELMKDGDKNNDGRIDYDEFLEFMKGVE

SEQ ID NO: 63 - protein, 174 aa, Oryza sativa
MGLVVSAAASCGRLRRSRSRSPPPAVLDPSQSPLSLEREAEPELIRVFRCFDTDGDGLISAAEMREFYGCSVDEAEEMVAAADRDGDGFVSIEELRAVMEGGGLDALRAAFDEYDEDGNGVITAEELRRALRRLNLDGMDLTAEQCAEIVAAVDSDGDGVISFDEFKAMMSKQA

SEQ ID NO: 64 - protein, 577 aa, Sus scrofa
MPKTINVRVTTMDAELEFAIQPNTTGKQLFDQVVKTIGLREVWFFGLQYQDTKGFSTWLKLNKKVTAQDVRKESPLLFKFRAKFYPEDVSEELIQDITQRLFFLQVKEGILNDDIYCPPETAVLLASYAVQSKYGDFNKEVHKSGYLAGDKLLPQRVLEQHKLNKDQWEERIQVWHEEHRGMLREDAVLEYLKIAQDLEMYGVNYFSSKNKKGSELWLGVDALGLNIYEQNDRLTPKIGFPWSEIRNISFNDKKFVIKPIDKKAPDFVFYAPRLRINKRILALCMGNHELYMRRRKPDTIEVQQMKAQAREEKHQKQMERALLENEKKKREMAEKEKEKIEREKEELMERLKQIEEQTKKAQQELEEQTRRALALEQERKRAQSEAEKLAKERQEAEEAKEALLKASRDQKKTQEQLALEMAELTARISQLEMARQKKESEAAEWQQKAQMVQEDLEKTRAELKTAMSTPHGAEPAENDQDEQDENGAEASADLRADAMAKDRSEEERTTEAEKNERVQKHLKALTSELANARDESKKTANDMIHAENMRLGRDKYKTLRQIRQGNTKQRIDEFESM

SEQ ID NO: 65 - protein, 164 aa, Oryza sativa
MACDQQAELRRVFELFDRDGDGRITREELTESLERLGMPVHREELAATIARIDANGDGCVDMDEFTQLYETVMRVDGGGGGGGGACDVDEASMREAFDVFDRNGDGFITVDELGAVLASLGIKQGRTAEDCGRMIGQVDRDGDGRVDFLEFKQMMRGGAFATLR

SEQ ID NO: 66 - protein, 191 aa, Oryza sativa
MASKYRGYYHDEASSAAGGGGGGGGGDGYRREKQVRKKRLTAQKRKEIKEAFDLFDTDGSGTIDPKELNVAMRALGFEMTPEQIHQMIAEVDKDGSGTIDFDEFVHMMTDKMGERDAREELNKAFKIIDKDNNGKISDVDIQRLAIETGEPFTLDEVREMIEAADENGDGEVDHEEFLKMMKRIGFGAGFF

SEQ ID NO: 67 - protein, 476 aa, Oryza sativa
MDEAWERAVEAALQAAGEGSSSPARSLTLDGAVKCLHGRLPAAEILERYQSLEHLSIAGVGVASLAGFPRLRNLTRLTLSDNRIAGGLDHLVAAGLASLRDLDLSNNRIQDVGDLSPLANLRLVSLDLYECPVTRVKDYRSKVFGMIRTLKYLDKMDADENERPESDDDDDDGDGDGDGEEEEDDDDDEDEDPGSGEVANGGVSHPRGGVASHPVEVNGVIDVDEDESDADEVVPNGGDEHHANGFRVAAVGDEDEYVEEEDDDDEEDYEEEDDLGEEIDEDGDDEDAVVEVHDVPSSSDEEEDGIEEEDEEEDEDEEEVEDDGEEAEPESSGRVALAVGDVGEEIDGHEHGEGEDEDENGEIGEEDEERLEDDRVYEEGNDDDEEDVDDEDEDTEYLVQPIAQPQAMAVGNDFDAAEADDADEDRDEVDDDDDGGTDLPSSSQGAKRKRDDDPSGSGDDDEDDDGVEDLRPFKHH

SEQ ID NO: 68 - protein, 664 aa, Sus scrofa
METPSQRRATRSGAQASSTPLSPTRITRLQEKEDLQELNDRLAVYIDRVRSLETENAGLRLRITESEEVVSREVSGIKSAYEAELGDARKTLDSVAKERARLQLELSKVREEFKELKARNTKKEGDLMAAQARLKDLEALLNSKEAALSTALSEKRTLEGELHDLRGQVAKLEAALGEAKKQLQDEMLRRVDAENRLQTLKEELDFQKNIYSEELRETKRRHETRLVEIDNGKQREFESRLADALQDLRAQHEDQVEQYKKELEKTYSAKLDNARQSAERNSNLVGAAHEELQQSRIRIDSLSAQLSQLQKQLAAKEAKLRDLEDSLARERDTSRRLLADKEREMAEMRARMQQQLDEYQELLDIKLALDMEIHAYRKLLEGEEERLRLSPSPTSQRSRGRASSHSSQTQSGGSVTKKRKLESSESRSSFSQHARTSGRVAVEEVDEEGKFVRLRNKSNEDQSMGNWQIKRQNGDDPLLTYRFPPKFTLKAGQVVTIWAAGAGATHSPPADLVWKSQNTWGCGNSLRTALINSTGEEVAMRKLVRSVTMIEDDEDEDGDDLLHHHHGSHGSSSGDPAEYNLRSRTVLCGTCGQPADKASASSSGAQVGGSISSGSSASSVTVTRSYRSVGGSGGGSFGDNLVTRSYLLGNSRPRTQSPQNCSIM

SEQ ID NO: 69 - protein, 1549 aa, Ovis aries
MSPLLRSIFNITKIFNQYASHDCDGTTLSKKDLKNLLEREFGEILRKPHDPETVDLVLELQDRDRDGLIDFHEFLAIVFKVAAACYYALGQASGLNEKEAKCERKGNPLQDRRREDQRRFEPQDRQLEERRLKRQELEELAEEEELREKQVRREQRLQRREQEEYGGEEELQQRPKGRELEELLNREQRFERQEQRERQRLQVEQQQRQRGELRERQEEVQLQKRETQELQRERLEEEQQLQKQKRGLEERLLEQERREQELRRKEQERREQQLRQEQEEATQEEISERGESRTSRCQWQLESEADARQRKVYSRPHRQEQQSRRQEQELLERQQEQQISEEVQSLQEDQGRQRLKQEQRYDQNWRWQLEEESQRRRYTLYAKPAQREQVREEEQLRLKEEKLQREKRRQERERQYREVELQREEERLQREEEQLQREEREKRRRQEREKQYLEKVELWEEEQLQREEREKRRQEREKQYLEKVELREEEQLQRQEREKRRQERERQYLEKVELQEEEQLQREEREKRRQERERQYLEKVELQEEEQLQRQEREKRRQEREKQYLEKVELQEEEQLQRQERQKRRQEREKQYLEKVELQEEEQLQRQEREKRRQERERQYLEKVELQEEEQVQRQEREKRRQERERQYLEKELQRQEERLQEEEQLLREEREKRRQERERQYLEKVELQEEEQLQREEREKRRQERERQYLEKEELQRQEERLQREKEQLQREDREKRRQVRERKYLEEELQQEEDRLQREKQLLREDREKRQYLEKVELQREEEQLQREKRRQERERQYREEELLREEERLHRKEQQLQREECEKRRRQELERQLEEEELQRLDRKRQFRDDDQHQNEVRNSRVYSKHRENKEKSRQLDDSWVRESQFQQDLRPLQDEQEEKREREQEWRSRQKRDSQFPAEQLLEREQQKETERRDRKFREEEQLLKGQREEKIRYLEEDRKFREEEQQLRRLEREQQLRQERDRKFREELSRQERDRKFREEEQLLQEREEQLRRQERDRKFREEEQLLQEREEQLRRQERDRKFREEEQLLQEREEQLRRQERDRKFREEEQQLRLLEREQQLRQERNRKFREEQLLREREEQLRLQEGEPQLRQKRDRKFHEEEQLLQEREEQLRRQERDRKFREEAQILKEREEQLRRQERDRKFREEEQLLQEREELRRQEREPQLRQERDRKFREEEQLLQEREKLRRQEREPQLRQERDRKFHEEEQLLQEREEQLRRQERDRKFREEAQLLQEREEQLRRQERDRKFREEEQLLQEREEQLRRQERDRKFREEEQLLQEREEQLRRQERDRKFREEEQLLKESEEQLRRQERDRKFHEKEHLLREREEQQLRRQELEGVFSQEEQLRRAEQEEEQRRQRQRDRKFLEEEQSLQREREEEKRRVQEQDRKFLEQEEQLHREEQEELRRRQQLDQQYRAEEQFAREEKRRRQEQELRQEEQRRRQERERKFREEEQLRRQQQEEQKRRQERDVQQSRRQVWEEDKGRRQVLEAGKRQFASAPVRSSPLYEYIQEQRSQYRP

SEQ ID NO: 70 - protein, 962 aa, Zea mays
MATFAKPENALKRAEELIHVGQKQSALQALHDLITSKRYRSWQKPLEKIMMKYVELCVDLRKGRFAKDGLIQYRIVCQQVNVSSLEDVIKHFMQLSNEKAEQAKSQVEALEDALDVEDLEADKRPEDLMLSFVSGEKGKDRSDKEVVTPWFKFLWETYRTVLEILRNNSKLEALYAMTAHRAFQFCKQYKRTTEFRSCVRSIRNHLANLNKYRDQRDRPDLTAPESLQLYLDTRVEQLKVATELSLWQEAFRSVEDIHGLMTMVKKMPKPSILVVYYAKLTEIFWISDSHLYHAYAWLKLFNLQKSYNKNLSQKDLQLIASSVLLAALSVSPYDKKYGAFETENEKERNMRLSNLVNFSLDNKRENREMPSRPYLLSELASKGVLSCASQEVRDLYNLLEHRFLPLDLASKVQPLLLKISKIGGKLSSASSVPEVKLSQYISALEKLTTLRVLQQASCIFKSIKIDMLSRMIPFFDFSVVEKISVDAAKQNFVAIKVDHLSGVVQFGTVDIESDGLSDHLSVLADSLNKARIHICPPVKKPSKLGESLISLAAIVENEHKRLLARKSIIEKRKEELERQILEKEKEEEKKRMSSQKKTVDEERVRLLNEQRQREQDRIRREIEEKNKAEAKKMLEDLNKAGKKHVVVEGELTKEAYMELARNEQLKERHEMEKKLQKFAKTMDYLERAKRQEEAPLIEQAFQKRLEEEKILHEQEQLREIELSKQHHASDLQEKNRLSRMLEHKNALQERIIQERAAEFGRLKKERDERMNRLISSRKHERETVRKLMFYLNLEEQRIEMLREEEEARKREAEERRKREEAERKAKLDAIAEKQRLREIELEEKAKATREKLLKGSEAVRAPDSAPVAQPPRESAAAAAAAAAAAPAPSKYIPKFKRGGDSSSIPSGSRDEDRWGSRGPLRQDGPPARLDAPSSRQDTDRWRGSRFPSNSTSSSSTWSRSRN

SEQ ID NO: 71 - protein, 146 aa, Oryza sativa
MVAATAEFRRVFSAFDRDADGKISAAELRLCMKAALGEDMSAEEAEALVSSADTDDDGLLDEEEFTKLAVQLEMGDEEERCRGLMEAFRMYEMEGEGRITPASLKRMLSKLGSHQGIEECQTMICRFDLDGDGVISFEEFKIMMDA

SEQ ID NO: 72 - protein, 796 aa, Sus scrofa
MAWDMCNQDSVWTDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTENEASPSSMPDGTPPPQEAEEPSLLKKLLLAPANTQLSYNECSGLSTQNHANHNHRIRTNPAVVKTENSWSNKAKSICQQQKPQRRPCSELLKYLTTNDDPPHTKPTETRNSSRDKCTSKKKAHTQSQSQHLQAKPTSLSLPLTPESPNDPKGSPFENKTIERTLSVELSGTAGLTPPTTPPHKANQDNPFRASPKLKPPCKTVVPPPSKKTRYSESSGTHGNNSTKKGPEQSELYAQLSKTSALGGGHEERKARRPSLRLFGDHDYCQSINSKAEILINISQELHDSRQLDSKDAASDWQRQMCSSTDSDQCYLTETSEASRQVSPGSARKQLQDQEIRAELNKHFGHPSQAVFDDEADKTSELRDSDFSNEQFSKLPMFINSGLAMDGLFDDSEDESDKLNSPWDGTQSYSLFDVSPSCSSFNSPCRDSVSPPKSLFSQRPQRMRSRSRSFSQHRSCSRSPYSRSRSRSPGSRSSSRSCYYSESGHCRHRTHRNSPLCARSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 73 - protein, 1107 aa, Oryza sativa
MAKPVKYDEEEEEVSSSGEEEEEQSDGAGSGSGEEEDEEEEEAPAAAAGEAAGGEEEEVDEEEIEAVTTGAGADEEEEESGAAAAAPGEGDEESQSTEDDEAVVGEDDDADEAEGGAVVGKREKARLKEMQKLKKQKIQEILDTQNAAVDADMNNKGKGRLKYLLQQTEIFAHFAKGNQSKEKKPRGRGRHASKMTEEEEDEEYLKEEEDALAGSGGTRLLSQPSCIKGKMRDYQLAGLNWLIRLYENGINGILADEMGLGKTLQTISLLGYLHEFRGITGPHMVVAPKSTLGNWIKEIQRFCPILRAVKFLGNPEERNHIRENLLQPGKFDVCVTSFEMAIKEKTTLKRFSWRYIIIDEAHRIKNENSLLSKTMRIYNTNYRLLITGTPLQNNLHELWSLLNFLLPEIFSSAETFDEWFQISGENDQQEVVQQLHKVLRPFLLRRLKSDVEKGLPPKKETILKVGMSQMQKQYYRALLQKDLEVINAGGERKRLLNIAMQLRKCCNHPYLFQGAEPGPPYTTGEHLVENAGKMVLLDKLLPKLKDRDSRVLIFSQMTRLLDILEDYLMYRGYQYCRIDGNTGGEDRDASIEAFNKPGSEKFVFLLSTRAGGLGINLATADVVVLYDSDWNPQADLQAQDRAHRIGQKKEVQVFRFCTEYTIEEKVIERAYKKLALDALVIQQGRLAEQKTVNKDDLLQMVRFGAEMVFSSKDSTITDEDIDRIIAKGEETTAELDAKMKKFTEDAIKFKMDDTAELYDFDDDKEENKLDFKKLVSDNWIEPPRRERKRNYSESEYFKQALRQGAPAKPREPRIPRMPHLHDFQFFNNQRLNELYEKEVRYLMQANQKKDTIDGEDEDQLEPLTAEEQEEKEQLLEEGFATWTRRDFNTFIRACEKYGRNDIRSIAAEMEGKTEEEVQRYAKVFKERYKELSDYDRIIKNIERGEARISRKDEIMRAIGKKLDRYKNPWLELKIQYGQNKGKFYNEECDRFMLCMVHKLGYGNWDELKAAFRMSPLFRFDWFVKSRTTQELARRCDTLIRLVEKENQEYDEQERQARKDKRMAKNMTPTKRSALRVSEGETTPSNSFKRRRQSLMDDYVGSGRRKRG

SEQ ID NO: 74 - protein, 232 aa, Pisum sativum
MAQSVSLSTIASPILSQKPGSSVKSTPPCMASFPLRRQLPRLGLRNVRAQAGGDGDNKDNSVEVHRVNKDDQGTAVERKPRRSSIDISPFGLLDPWSPMRSMRQMLDTMDRIFEDAITIPGRNIGGGEIRVPWEIKDEEHEIRMRFDMPGVSKEDVKVSVEDDVLVIKSDHREENGGEDCWSRKSYSCYDTRLKLPDNCEKEKVKAELKDGVLYITIPKTKIERTVIDVQIQ

SEQ ID NO: 75 - protein, 583 aa, Sus scrofa
MPKPINVRVTTMDAELEFAIQPNTTGKQLFDQVVKTVGLREVWFFGLQYVDSKGYSTWLKLNKKVTQQDVKKENPLQFKFRAKFFPEDVSEELIQEITQRLFFLQVKEAILNDEIYCPPETAVLLASYAVQAKYGDYNKEIHKPGYLANDRLLPQRVLEQHKLTKEQWEERIQNWHEEHRGMLREDSIMEYLKIAQDLEMYGVNYFEIKNKKGTELWLGVDALGLNIYEHDDKLTPKIGFPWSEIRNISFNDKKFVIKPIDKKAPDFVFYAPRLRINKRILALCMGNHELYMRRRKPDTIEVQQMKAQAREEKHQKQLERAQLENEKKKREIAEKEKERIEREKEELMERLRQIEEQTMKAQKELEEQTRKALELDQERKRAKEEAERLEKERRAAEEAKSAIAKQAADQMKNQEQLAAELAEFTAKIALLEEAKKKKEEEATEWQHKAFAAQEDLEKTKEELKTVMSAPPPPPPPPVVPPTENEHDEHDENNAEASAELSNDGVMNHRSEEERVTETQKNERVNKQLQALSSELAQARDETKKTQNDVLHAENVKAGRDKYKTLRQIRQGNTKQRIDEFEAM

SEQ ID NO: 76 - protein, 802 aa, Oryza sativa
MDADFRFDPDGSDDDGAAASAAAGRRKPAQSPWEFSSYAESVAAEHARRRTTSIDEKISQALSGSRRGGKPSIPDGDSEGDEDDSEVEDDSEEDDKEVVEGEIDDEEDEVEESEDDDEGVEVSDEEVEELEEGKGEEKSDEVEEGEEGQDGEEEEKEEGDEEAAEEEEETDKKSGVVDPSKFFASSEGASFHANSFLELNLSRPLLRACEALGYQKPTPIQAACIPLALTGRDICGSAITGSGKTAAFSLPVLERLLFRPKRVPAIRVLILTPTRELAAQVHSMIEKLAQFTDIRCCLIVGGLSTKVQEVALRSMPDIVVATPGRIIDHLRNSLSVGLEDLAILILDEADRLLELGFSAEIQELIRMCPRRRQTMLFSATMTEEINELVTLSLNKPVRLEADPSLKRPATLTEEVVRIRRAREANQEAVLLALCLKTFKDKVIIFSGTKHSAHRLKIIFGLSGMKAAELHGNLTQAQRLEALELFKKQEVDFLIATDVAARGIDIVGVRTVINFSCPRDARTYLHRVGRTARAGREGYAVTFVTDDDRSLLKAIAKKAGSQLKSRIVAEKPVAECAKLIEELEDQISTIIQEEREERILRKAEMEATKAENMIAHKDEIYSRPKRTWFATEKEKKLLAKAAKESTSQGKSNSGVISAQQAEDLRLKEKKRREREKNLPRKKRRRLEAEREMLEDESEDEEEAKESKGGKKEKKGQSLVDVAYRRAKSMKASGKRGAGTGKGKNDKKAKQHSGKGPTRQEEMQELFQNDMSEWKQGRSLKKNNVMRKKSKNSFKSKSRYNRRK

SEQ ID NO: 77 - protein, 415 aa, Oryza sativa
MARGKNHPDGEEEEAPAAAGEEEAPVEMDEEGEMEEEEEEEQGEGEGEERDEGEEEEEWEDAEEVEGGEESEQAAAEEEDSPLVVVEAEAAAPVVDGSPPKLAEGYYEIEDIRRRRLRKGKLQYLVKWRGWPESANTWEPLENLSACSDIIDAFEMRLQSPRPGRKRKRKITTTPVAGSNPSHGKRGRPRLDAKSHTRAPAPEPKQLPCRTSCRRATNCSSKTVAGLDASGSVVRNQLAQNIVQEGSSSVISRTPCQELPLSIRLTDQQNEHHLVNGSSNSENLVKVPPSQGGQVTGAKKRKSGNVRRFEQNKPTQGQGECGALVVAEDVGSTEGETGDKKKTEGCPNRVHITKIIKPVRFAAAVNNDVQQVSITFKALRSDGQEVMVDDKELKANNPLLLISYYEQCLRYNPTS

SEQ ID NO: 78 - protein, 134 aa, Sus scrofa
MTRDQNGTWEMESNDNFEGYMKALDIDFATRKIAVALTQTKIIEQDGDKFKTKTNSTFRNYDLDFTVGVEFDEYTKGLDNRNVKTLIIWEGDALVCVQKGEKENRGWKQWVEGDKLYLELTCGDQVCRQVFKKK

SEQ ID NO: 79 - protein, 567 aa, Oryza sativa
MADPYGDGKGLKQQQRQKLKPALEVEDFINLLHGSDPVRVELTRLENELQYKEKELGEAQAEIKALRLSERAREKAVEDLTEELTKVDGKLKLTESLLESKNLEAKKINDEKKAALAAQFAAEATLRRVHAAQKDDDMPPIEAILAPLEAELKLARHEIAKLQDDNRALDRLTKSKEAALLEAERTVQIALAKASLVDDLQNKNQELMKQIEICQEENKILDRMHRQKVAEVEKLTQTVRELEEAVLAGGAAANAVRDYQRKVQEMNEERKTLDRELARAKVSANRVAVVVANEWKDGNDKVMPVKQWLEERRILQGEMQQLRDKLAIAERAARSEAQLKDKFQLRLKVLEEGLRMSTTRTNVSAARRQSIGGADSLSKTNGFLSKRPSFQMRSSVSTTTTTLVNHAKGASKSFDGGCRSLDRYKGHVNGSGMNVSTDSSEDKESNNSDEKANEFTSVETEDTVSGLLYDTLQKEVIALRKACHEKDQSLKDKDDAVEMLAKKVDTLTKAMESEGKKRRMEVAAMEKEMAALRLEKEQDNKAKRFGSSSSQLPPGRTLPRSGSARNM

SEQ ID NO: 80 - protein, 158 aa, Glycine max
MTKFTILLISLLFCIAHTCSASKWQHQQDSCRKQLQGVNLTPCEKHIMEKIQGRGDDDDDDDDDNHILRTMRGRINYIRRNEGKDEDEEEEGHMQKCCTEMSELRSPKCQCKALQKIMENQSEELEEKQKKKMEKELINLATMCRFGPMIQCDLSSDD

SEQ ID NO: 81 - protein, 1049 aa, Oryza sativa
MGSSDEAGSSKHHRRDKEKDRERSSSRHHRDRDRERSSSRHHHREDRDDDRDRDRDRERRHREKERDREERKAREREEREKEKERERARRREERDREERSRRREAAAEEEEEDVDRDRKRRRRSSHHHHHHRDAEPEGPASGAREEEVVDVEEAERRRQKKKEEEQKQLDEEMETRRRRIKEWQEMKRREEETKRREQEEAGVGTSAAAAAAPAEAEDGGNAGKKWTLDGEESDEEGNQEDGKKSDDNGGSGAGAMDVDVPNGGDNANGANAMDEDEIDPLDAFMNSMVLPEVAKLESMPAANVDDKNDKSAKDAVTNGDKKGPKKVMGRIIQGEDSDSDYADDEDDEGGSEDEDDEEFMKRVKKTKAEKLAIVDHSKIDYQPFRKNFYIEVKDITKMAAEEVAAYRKQLELKVHGKDVPKPIKTWVQSGLTSKLLDTIKKLGFEKPMSIQAQALPIIMSGRDCIGIAKTGSGKTLAFVLPMLRHVKDQPAVVPGDGPIGLIMAPTRELVVQIHSDIKKFSKALGINCVAIYGGSGVAQQISELKRGAEIVVCTPGRMIDILCTSSGKITNLRRVTFLVMDEADRMFDMGFEPQITRIVQNTRPDRQTVLFSATFPRQVEILARKVLTKPVEIQVGGRSVVNKDITQLVEVRPENERFFRLLELLGEWFDKGKILVFVHSQDKCDSLLKDLFQHGYPCLSLHGGKDQTDRESTLADFKSNVCSLLIATSVAARGLDVKELELVVNYDVPNHYEDYVHRVGRTGRAGRKGFAVTFISEEEERYAPDLVKALELSEQAVPEDLKGLADRFMAKVKQGTEQAHGTGYGGSGFKFNEEEDEARKSAKKAQAREYGYEEDKSDSDSDEEGGVRKAGGDLAAQAIAAAQAAAAMVAAKAASNANQQTQGTSVGPLLPLAIASNTQNNEATARALQAAFNIQQNLARIQAHAVPEHYEAELEINDFPQNARWKITHKETLGPIQEWTGAAITTRGTFFPQGKIVGANERKLYLFIEGPTELSVKKAKAELKRVLEDCANHALNLPGSAQTGKYSVI

SEQ ID NO: 82 - protein, 157 aa, Sus scrofa
QEPQPEQDPFELSGKWITSYIGSSDLEKIGENAPFQVFMRSIEFDDKESKVYLNFFSKENGICEEFSLIGTKQEGNTYDVNYAGNNKFVVSYASETALIISNINVDEEGDKTIMTGLLGKGTDIEDQDLEKFKEVTRENGIPEENIVNIIERDDCPA

SEQ ID NO: 83 - protein, 300 aa, Zea mays
MEFWGLEVKPGSTVKCEPGYGFVLHLSQAALGESKKSDNALMYVKIDDQKLAIGTLSVDKNPHIQFDLIFDKEFELSHTSKTTSVFFTGYKVEQPFEEDEMDLDSEDEDEELNVPAVKENGKADEKKQKSQEKAVAAPSKSSPDSKKSKDDDDSDEDETDDSDEDETDDSDEGLSPEEGDDDSSDEDDTSDDEEEDTPTPKKPEVGKKRAAESSVLKTPLSDKKAKVATPSSQKTGGKKGAAVHVATPHPAKGKTIVNNDKSVKSPKSAPKSGVPCKSCSKSFISETAPQAHSKAKHGGK

SEQ ID NO: 84 - protein, 670 aa, Oryza sativa
MAAAAAASSMAKRKQRKAATEQEVENHDEATVAAEAGPENDGHTAHAAEEAAAAEEGVEREGGGEGGAEGEEGPDAAARGGEEGKEEEEREVSFDELGLDEQLKRALRKKGLDKATPIQREAIPLILEGKDVVAKAKTGSGKTFAYLLPMLHELLKLSAEGRIRKSAPNVFILVPTRELCQQVHNEASSLLEFCTSKLKVVQVNASMSDKDIKVALSGPPNILVTTPACVASCISKGIIRGSSIKESLSMMILDEADLLLSYRCEDDIKALVPHIPRSCQSILMSATSSADIEKLTKLLLHNPFILTLTEVGHAKDDLIPKNVQQFWISCDAKDKMLYILVLLKLELIQKKVLIFVNSIDSAFKLRLFLEKFGIRSSVLNAELPQNSRLHIIQAFNARLFDYLIATDDNKSKEERQANKGNKKDSRVSRKQLQQTLDAEFGVVRGIDFKNVFTVVNYDMPPDPAGYVHRVGRTGRANKTGASISLVSPKENGIFEDIENMLKDVENRDTSCISPFPLLTKNAVESLRYRAQDVARSVTTRDIKEARRQDIKNEILNSEKLKAHFDENPRDLDLLKHDKLLSNKEIPAHLRDVPEYLIDPTTKEASNVVKLSRAAMDIDKPRRRKRMGFKGGSGRSSDPLKTFSAEGKSRRRGRKERDGEQDRRKRKKVES

SEQ ID NO: 85 - protein, 697 aa, Solanum lycopersicum
MATSCFPPFSASSSSLCSSQFTPLLSCPRNTQICRKKRPVMASMHSENQKESNVCNRRSILFVGFSVLPLLNLRARALEGLSTDSQAQPQKEETEQTIQGSAGNPFVSLLNGLGVVGSGVLGSLYALARNEKAVSDATIESMKNKLKDKEDAFVSMKKQFESELLSEREDRNKLIRREGEERQALVNQLKSAKTTVISLGQELQNEKKLAEDLKFEIKGLQNDLMNTKEDKKKLQEELKEKLDLIQVLEEKITLLTTEIKDKEVSLRSNTSKLAEKESEVNSLSDMYQQSQDQLMNLTSEIKELKDEIQKRERELELKCVSEDNLNVQLNSLLLERDESKKELHAIQKEYSEFKSNSDEKVASDATLGEQEKRLHQLEEQLGTALSEASKNEVLIADLTREKENLRRMVDAELDNVNKLKQEIEVTQESLENSRSEVSDITVQLEQLRDLSSKLEREVSKLQMELEETRASLQRNIDETKHSSELLAAELTTTKELLKKTNEEMHTMSDELVAVSENRDSLQTELVNVYKKREHTRNELKQEKTIVRTLEEELKFLESQITREKELRKSLEDELEKATESLDEINRNVLALAEELELATSRNSSLEDEREVHRQSVSEQKQISQEAQENLEDAHSLVMKLGKERESLEKRAKKLEDEMAAAKGEILRLRSQINSVKAPVEDEEKVVAGEKEKVNVQQ

SEQ ID NO: 86 - protein, 158 aa, Solanum lycopersicum
MQEQATSSIAASSLPSSSERSSSSALHHELKEGMESDDEIRRVPEMGGEATGTTSASGRDGVSAAGQAQPSAGTQRKRGRSPADKENKRLKRLLRNRVSAQQARERKKAYLIDLEARVKELETKNAELEERLSTLQNENQMLRHILKNTTAGAQEGRK

SEQ ID NO: 87 - protein, 599 aa, Oryza sativa
MADGGGGEEGSASALRGSARRRGAVQPAGLDADELLTLMHGSDPVKVELNRLENEVRDKDRELGDAHAEIKALRLSERAREKAVEELTAEYEKLDEKLKLTESLLESKNLELKKTNDEKKAAMAAQFAAEATLRRVHAAQKDDDMPPIEAILAPLEAELKLARQEIAKLQDDNRALDRLTKQKEAALLEAERTVEIALAKAAMVDDMQNKNQELMKQIEICQEENKILDRLHRQKVAEVEKLSQTVRELEEAVLAGGAAANAVRDYQRKVQEMNEERKILDRELARAKVTANRVAVVVANEWKDANDKVMPVKQWLEERRFLQGEMQQLRDKLAIAERTARSEAQLKEKYQLRLKVLEDGLRGPPSGSSRPTEGKSIGNGPSRRLSLGGADNMSKISPNGMLARRSPSFNSRSSLSTSSSLVIKHAKGTSRSFDGGTRSLDRGKVLGNGPHLLNRSTDAVRDCETTDDWKAANTEEKGSEATNSSSTDTVSGVLYDMLQKEVISLRKACHEKDQSLKDKDDAIEMLAKKVDTLTKAMEVEAKKMRREVAAMEKEVAAMRLDKDQENKAKRPGNFKGPGTTSQAPHGRNAPRGGLTRNLQ

SEQ ID NO: 88 - protein, 545 aa, Sus scrofa
MATSAPLRSLEEEVTCSICLDYLRDPVTIDCGHVFCRSCTTDIHPVSGGRPVCPLCKKPFTKENIRPVWQLASLVENIERLKVDTGRQPGEVAREQQDTRLCERHQEKLHYYCEDDGKLLCVMCRESREHRPHMAVLVEKAAQPHREKILNHLSTLRRDRDKIQGFQAKGEADILAELKKLQDQRQRILAAFEQGHQFLWEREQHLLDQLAKLEQEVTEGREKYKTRGDGELARLAQVISELEGKAQQPAAELMQDTRDFLTRYPRKKFWIGKPIARVVKKRTGEFSDKLLSLQRGLREFQGKLLRDLEYKTVSVTLDPQSASGYLQLSEDWKCVTYSGLYQSSYLHPQQFECEPGVLGSKGFTWGKVYWEVEVEREGWSEDEEEGDEEEEGEEEEEEEEAGYGAGFGYGDGYDDWGTDEDEESLGDEEEEEEEEEEEVLESCMVGVARDSVKRKGDLSLRPEDGVWALRLSSSGIWANTRPEAELFPAQRPRRVGIALDYEGGTVTFTNAESQELIYTFKATFTRRLLPFLWLRWPGTRLLLRP

SEQ ID NO: 89 - protein, 582 aa, Salmo salar
MGGLQKKKYERGSATNYITRNKARKKLQLSLADFRRLCILKGIYPHEPKHKKKVNKGSTAPRTFYLLKDIRFLLHEPIVRKFREYKVFVRKLRKAYGKAEWTGVERLRDNKPGYKLDHIIKERYPTFIDALRDIDDALSMCFLFSTFARTGKCHVQTITLCRRLTVEWMNYVVTSRSLRKVFLSIKGIYYQAEVLGQLITWLVPYQFAHDHPTDVDYRVMATFTEMYTTLFGFINFRLYQTLNLVYPPKLDSKAESELKAEHEEDYAMDSESYLEKLSALSASLARVVATVEEEENQLDNFPTEEEDQENMQAREKEQKEQEAQKRLFEGLKFFLNREVPRESLAFILRCFGAEVSWDKSLCIGGTYEVTDETITHQIVDRPDMDKQYINRYYIQPQWVFDSVNAKMRLPVEDYFLGTMLPPHLSPFVEEKDGDYVPPEKLKLMALQRGEKPVQEEDEEEEDEDEEEDDDVDDEEFTEEKNLKKMEDTRAQGKTLSVKVTPGKVKPWETGSVGNKVRLEQEEKAEEKRLAIMMMKKKEKYLYDKIMFGKKRTTREVNKLTAKRKAHEDASKAQKKQKKAKKQ

SEQ ID NO: 90 - protein, 618 aa, Sus scrofa
MATIPDWKLQLLARRRQEEAAVRGREKAERERLSQMPAWKRGLLERRRAKLGLSPGEPSPAPGTTEAGPPDPDKSAVLLEAIGPVHQNRFIRQERQQQQQQQQQQQQQQRSEELLAERRPGLLEAREWRSSPGEMRDQSPKERESREERLSPREARERRLGIGGARESSPRPLESRDWRQSPGEAGDRSSRLSEVRKWRLSPGETPERSLRPAEPQEQSPRRKEVVESRLSPADSDHEKLGLTDAHKRRPDSGESQEQSLVLEASEWRLSSGEERKDCLEECGRKEERTLPGMVPEDITGSPETLTMEAAGSSSGGVEAADQRPIPVEDGERDLRLSEGWKWTLNSGKVRDRTPRDTETQSQKPESAEKHLGPLGAEAGEGEAEKEEAGAQGRPLSALQNRCSVPSPLPPEDAGTGGSRQQEEEAGELRPPPAAPLSPPPPAPPAPQPPGDPLMSRLFYGVKAGPGVGAPRRSGHTFTVNPRRSAPPAAAATPATPATADAAVPGAGKKRYPTAEEILVLGGYLRLSRSCLAKGSPERHHKQLKISFSETALETTYQYPSESSVLEELGPEPEAPSAPSPPAAQPDDEEDEEELLLLQRELQGGLRTKALIVDESCRR

SEQ ID NO: 91 - protein, 198 aa, Solanum tuberosum
MAELEAKKVEIVDPAPPAPGPVEAPKEVVADEKAIVAPALPPPAEEKEKPDDSKALVVVETKAPEPADEKKEGSIDRDAVLARVATEKRVSLIKAWEESEKSKAENKAQKKVSAIGAWENSKKANLEAELKKMEEQLEKKKAEYTEKMKNKIALLHKEAEEKRAMIEAKRGEDLLKAEELAAKYRATGTAPKKILGIF

SEQ ID NO: 92 - protein, 153 aa, Oryza sativa
MAPKAEKKPAAKKPAEEEPAAEKAEKAPAGKKPKAEKRLPAGKAEKGSGEGRKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 93 - protein, 591 aa, Triticum aestivum
MAEHDAPPESGAARSPPAKKRGGDARSPQQDAQPLSSRDRVRERDEDKDRERHRRHGEDRERYRDRESVRERGEGSRDRERHRREHREESRDRERHHREHREGSRDRERHHREHREGSRDRERHHREHREGSRDRERHHRDHREGSRDRERHHRDHRERSERREHRDRSDDRDYRRSCDRDAERRDRDRDGHRRHRSRSPLRSESQSKRMSGFDQRPSEAIPILAPDATPSQLPELPAANPGMFPNMLPNLVNVPALGQPLAMTQQATRHARRVYVGGLPPIANEQTVAVFFNQVMAAIGGNTFALGHAVVNVYINHDKKFAFVEMRSVEEASNAMALDGIMFEGAPVKVRRPTDYNPSQAAALGPSQPNPNLNLAAVGLTPGAGGGLEGPDRIFVGGLPYYFTEAQVRELLETFGPLRGFDIVKDKETGNSKGYAFCLYKDGTVTDIACAALNGIQLGDRTLTVRRANQGAEPRPEQENILLQAQQEAQMKRLVYEVGRTLTTKVVCLTQVVSADDLRDDEEYNDILEDMTLEGHKYVPHSTIAESFIIRPHAKFAIRPKLTEDTNLFHLDLTNHMFSSLPFCHVHVCSY

SEQ ID NO: 94 - protein, 693 aa, Oryza sativa
MAAGSHGGYRGYEVAREREHDVGVSRRSKEHYHHRHPSRHRDSERRRDGGRSGGRELSNGYSHRRDSPRPPPRRRPSEGRTEDREPGEVSGGSGSERSGERPMKTREPRENGVTRVSKEEAKMSPSKKRKQSPVIWDRNGSQRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEKAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQWMKEQGNNGDRGLFG

SEQ ID NO: 95 - protein, 844 aa, Oryza sativa
MDAAALQYENQKLVQQLEAQKSKMRALEGKFKELRDEQCSYDNTLICLNKMWNQLIDDLVLLGVRAGGDLNGLQALDHEEMSEESLESCPSEEIFLFRLLNSRNFRNNDDSSLSKLVEEALALRYSTTVTLMKSLQEAFAVQQARSESLSLALNGQNSSEDVIVALENHNDYLKEVVDNLRQAVSIINRKHEKYLDEIEAFKNNQSRELHEVKCLSGELEESMAELEESRRKLAVLQLQTGGGSLMNTSAPNGVNGSVSTDKSSDKGMGWRDLKDAVEEAKTLAANRLFELHETQEDNLILSKQLEDIQDQLKDENYIVTSKPYTILSDQLHHLNAEIERYRGLVEVLQNEKDQLMQKEEEMLAKAESVDAVQQSITTYKAKIEDLEHEIQKLMAEKNDLEIKAEEALQDSGKKDFKDEIHVMAASLSKEMELLDNQMNRSKDAASEALALREEADYLRTLLAKKIDEQKEISDRYNTQVTEIKSLKALIETLDQEKQELQFIVDMLGKECSESRAISEIEESENRARKQAEYLRKCLEEHNLELRVKAANEAETACQQRLSIAEAELEDLRAKVDASERDVMKLKESIRIKEAEVDGHISEIETIGQAYEDMQTQNQHLLQQVADRDDFNIKLVSDSVKMKQAYGSLLAEKNMLQKQLQHVNSSLESSKLKITSGEEQMKTYVAQAMKSSSENRHLAISLERTMLEVSDAEKELKWLRSATGSAEKEYEINQKKIAELKMELERERNERIKLEEEYEEVKNEVSELTSETEETTIQKLQDEIKECKAILKCGVCFDRPKEVVITKCFHLFCSPCIQRNLEIRHRKCPGCGTPFGQSDVREVKI

SEQ ID NO: 96 - protein, 844 aa, Oryza sativa; identical to SEQ ID NO: 95

SEQ ID NO: 97 - protein, 807 aa, Sus scrofa
MPKGPKQQPPEPEWIGDGESTSPTDKVVKKGKKDKKTKKTFFEELAVEDRQAGEEEKVLKEKEQQQQHQQQQQKKKRDTRKGRRKKDVDDDDGEEKELMERLKKLSVPASDEEEEAPAPVPRGGKKNKGGNVFAALIQDQSEEEEEEEKHPPKPAKPEKNRINKAVSQEQQPGPKGRKGKEEKSKGKAKPQNKFAALDDEEEQDEEEIKEKEPPKQGKEKAKKAEQMEYERQVASLKAANAAENDFSVSQAEMSSRQAMLENASDIKLEKFSISAHGKELFVNADLYIVAGRRYGLVGPNGKGKTTLLKHIANRALSIPPNIDVLLCEQEVVADETPAVQAVLRADTKRLKLLEEERRLQGQLEQGDDTAADRLEKVYEELRATGAAAAEAKARRILAGLGFDPEMQNRPTQKFSGGWRMRVSLARALFMEPTLLMLDEPTNHLDLNAVIWLNNYLQGWRKTLLIVSHDQGFLDDVCTDIIHLDAQRLHYYRGNYMTFKKMYQQKQKELLKQYEKQEKKLKELKAGGKSTKQAEKQTKEALTRKQQKCRRKNQDEESQEAPELLKRPKEYTVRFTFPDPPPLSPPVLGLHGVTFGYEGQKPLFKNLDFGIDMDSRICIVGPNGVGKSTLLLLLTGKLTPTRGEMRKNHRLKIGFFNQQYAEQLRMEETPTEYLQRGFNLPYQDARKCLGRFGLESHAHTIQICKLSGGQKARVVFAELACREPDVLILDEPTNNLDIESIDALGEAINEYKGAVIVVSHDARLITETNCQLWVVEEQSVSQIDGDFDDYKREVLEALGEVMVSRPRE

SEQ ID NO: 98 - protein, 668 aa, Sus scrofa
MQPAVLLGFLGATVVAAVSSMPVDNRNHNEEMVAHCIIEVLSNALSKSNAPPITPECRQVLKKGGKEVKDEEKGANENTRFEVRLLRDPADTSETQRPSGGREGAEAPSEDTQGPPGADVEGGGHSREGAGKPRGGPYSSDNPVAKEGKTRHSEKSEGQDREEEEGEKYQKRERGEEGSEERHLQEPGETQTAFLNQGNRATAKKKEEFESRYDAHSAGGPAKTHSRERSSQESGEETGSQDAAPGEPESPPEGQEAPEESQEDASLEVDKRRWRPRHHHGRSRPDRAPQEGSPPPEERGHPREESEESVLGLASPGGQRTRHPTHYPASEEEAEHGEEVRSSSSVQAPGDLVGARYGGRGGAEHRAARRPGEESPEQDRRVGASSELRNKGPGHSEESEEERGDEGQRHHRAWAGGPRADAPPDPAEEEQFWGEAHRPVPESQVDEARRHPQAKLRNYLNRGEENGEEGAPGRWQQPEDLQGPGEHAAEARLPGKPYAAHRIPEKKRLGELLNPYYVPPQWESSHFERKDNVGDNFLEGEDANGVTLNEKTFFPEYSYDWWEKKPFEEDVNWGYEERNLAPKLDLKRQYDRVAELDQLLHYRKKSAEFPDFYDSGEHLSPRHAAESEKERAGQGVLTEEEEKELENLAAMDLELQKIAEKFSGNRRG

SEQ ID NO: 99 - protein, 486 aa, Salmo salar
MSLHEINENVKLAREYALLGNYSSAIVCYRGVLEQIKKYLFTVRDSSFQQKWQQVWQEINEENNQVQEIMRTLESFQLETTPSKPPSNQDGINDIWPVQVERRSSPLPVRRPPVPYKDSKPHNNRLSVAGVRAQHRQSPRGANGDRAKPLKGKEKKEAKPKDDKNKAEVSEKEVKRFDGQGYDKDLIEALERDIISQNPNVKWDDIADLEEAKKLLKEAVVLPMWMPEFFKGIRRPWKGVLMVGPPGTGKTLLAKAVATECRTTFFNVSSSTLTSKYRGESEKLVRILFEMARFYAPTTIFIDEIDSMCSRRGTSEEHEASRRVKAELLVQMDGVGGASDNEDPSKMVMVLAATNFPWDIDEALRRRLEKRIYIPLPSAKGRVELLRINLKELELANDVDMAKIAEQSEGYSGADITNVCRDASLMAMRRRIEGLTPEEIRNISRAEMHMPTTMEDFESSLKKVSKSVSASDLEKYEKWIEEFGSC

SEQ ID NO: 100 - protein, 307 aa, Zea mays
MEFWGLEVKPGSTVKCEPGYGFVLHLSQAALGESKKSDNALMYVKIDDQKLAIGTLSVDKNPHIQFDLIFDKEFELSHTSKTTSVFFTGYKVEQPFEEDEMDLDSEDEDEELNVPVVKENGKADEKKQKSQEKAVAAPSKSSPDSKKSKDDDDSDEDETDDSDEDETDDSDEGLSSEEGDDDSSDEDDTSDDEEEDTPTPKKPEVGKKRPAESSVLKTPLSDKKAKVATPSSQKTGGKKGAAVHVATPHPAKGKTIVNNDKSVKSPKSAPKSGGSVPCKPCSKSFISETALQAHSRAKMGASESQVQ

SEQ ID NO: 101 - protein, 1812 aa, Sus scrofa
MSEILCHWLNQELKVSQTVSPKSFAKAFSSGYLIGEVLHKYELQDDFAEFSEKRISSAKLNNFSRLEPTLHLLGVQFDQNVAHDIITEKPGVAMKLLYQLYIALQRKKKSGLTGVELQTMQPLTNTKLQNMKSEAFRDRLRNLIPRQTDVSLMRVSHRFQEKYKYKDEDLVHTHLKKLENFQKLQEEQRSFNIEKQRLSRRRQNEIMAQIQAAIIQIPKPASNRTLKALDAQKMMKKKKEAEDVANEIKKFEALIKKDLQAKESASKTSLDAAGQTTTDLLNTYSDDEYIKKIQKRLEEDAFAREQREKRRRRLLMDQLIAHEAQEEAYREEQLVSRLMRQSQQERRIAVQLMHVRHEKEVLWQNRIFREKQYEERRLKDFQDALDREAALAKQAKIDYEEQALREKEMHEQIAAERVQARYKKHYSICAEILDQILDLSTKVADYRMLTNNLIPYKLMHDWKELFFNGMPIYEQASLKHLSAKPSTEQLIELEKRDLLDNNDYEEYKNMVGEWALPEEMVDNIPPSDNRILGHVIHRLIEHSLPPQVESTAPELPSFAIKGCLLGKTFSGKTTALKFLQKYFPIEVLSIDTLVQEAIQAFHNNEKVSGALQLQKAAEEKASPVRQESGDRSQNLHNVLSAEGTPETEDETRLSTKKTPKAEEVIASASLSELTTRAQLGAKSEKLLKKGKSISDTLLVSIVVNAINQIPIYKGWILDGFPMTLNQAKLLEEALTGFNRNLIELEGKKSQISTLAVDPTASREVPLPPSAFDFVMLLDISDNTSLNRMNDIMAEAFLSETPHENINQRVAAENQDMDEDQNLRDQIQHRIIGFWDHWPSLEQWFTEPENILIKMNAEVDEQSLCQKVKEMFMAEIMKKENKAKKKSEEKEAEKKEEFSLPEATPPTPPAPPPSEPEKEKEAHPPHERSKTPTAKGKPASEPPHGNRESPQEGKGKKSETSPKRKGSPRGKSPGGKAPVKKSPADSTDVSPVPAVPPPSKPGSEEWVFVNEPIPEEIPLFLVPYWKLIENSYINSIKTVLRHLREGQHTVLAYLYDTRTGFQQFLRRPDHKQNFVSQWQADFNSLPDDLWEDEETKAELHQRVNDLRDRLWDICDARKEEAEQERLDIINESWLQDSTGIAMNHFFSLMQAELNRFQDTKRLLQDYYRGMECKIPTDDTKRFTRIPLVQLDNKDTLEFQLRIPLVPRRSISPESALSKPKIKALLKGNIDYSLENVELNFEADEKVVMDTWQQASLAVSHMVAAEIHQRLMEEEKENQPADTKEKPPQAAANKKVKKEPPKKKREDKKGKGKSPPMAESAPVITVEEIAEMERKNELRLRIKEEHLAALQFEERATQFRLELIKTKALAFLEDLVTKAVDVYKLMEKWLGERYLNEMASVEKLTEVARYHIETSTKIQNELYLDQEDFFINGNIKVFPDPPPPVRPPPVEKEENGTLTIEQLDNLRDQFLDIAPKGVIGNKAFADILLDLVTLNLGTNNFPSSWMHLTQPELQELASLLVINSELVDWRKFLLVAALPWPIPLEEELLETLQRFKAVDEEQLGTVTFEQYLQAGLWFTGDKDIKIPANPLEPLPFNRQEHLIEFFFRLFADHDKDPPRLDYTEMLLYFACHPDGMEGVYRALSVATGSHVFQPIETPVLVAEKTSSFIDMSPTEEYPEPEDNFISEERELQEEGEEKEEDIPENANTEMISMETLLKVFRGGNEPQDTNRFASYPKTESIYSENFIKVFQDLGSKNLEPIEVAVLLKHPFIQDLIRSYPDYKIPDIKVVLQRSEHIQGSDGESSPSRLTEEKK

SEQ ID NO: 102 - protein, 832 aa, Oryza sativa
MAAAPPPPPPPQLQSSDPSTPPQETSQVRKGKKSRGAKKPRRAAAAAAASTSSAGTMVEDPFLVLAGGKEGGFLELEEIDEADFGIFGGAVEDLGEIDRKAGKDQKKKKRKKRKRGDDDYALPGDGDLVVECEEEGEKGEKRVKKKRRSRKKRKVKEMEEKMESKEDVSDDNVEDMQDGNDMEQDNNDGLILGEDEVYAWRELRLHPLLITAVRRLGFKEPTPIQKACFPAAAHQGKDVIGAAETGSGKTLAFGLPILQRLLEEQEKAMRLSREDESTQDENSRESPLRALILTPTRELAKQVCDHLKEAAKFLRIQVVPIVGGLSMEKQERLLKRKPEIVVGTPGRLWELMSTGNQHLIKLHSLSFFVLDEADRMIERGHFHELQSIIEMLPVTNGSDEQTVGTTPSCETVPILQIKKRQTFVFSATLALSANFRKKLKRGLVTAKASASTDLSSIEALSKQARMKPNAEIVDLTKASILPEKLEESFIECSDDDKDAYLYYILSVHGQGRTIIFCTSIAALRHLSSILRVLGINVLTNHAQMQQRARMKAVDRFRESENSILVATDGFARGMDFDDVRTVIHYQLPHSTDVYIHRSGRTARKSMAGCSIALISPADKAKFYSLCKSLSKENLQQFPVDHAYMPAVMNRLTLARQIDKITRKNSQENANKSWLQRNAESMGLLLETSDSEEERVQGHKQRKATSANLQKLQQDLSELLQRPLQPKTFSRRYLAGAGVSPLLQKQLEELSKRNVKGSASVNANKGSRFVVIGQDQIEPLQALQNSGQEVCVSIDKQREKRRLAENWRRKKQKEKKSTREQKRKEKRIAKERD

SEQ ID NO: 103 - protein, 832 aa, Oryza sativa; identical to SEQ ID NO: 102

SEQ ID NO: 104 - protein, 515 aa, Oryza sativa
MGSLGEVVEHGVSKDMLPFDGHPDPVVDELNRLENLLREKDRELGHAYSEIKGLKVTEALKDKAIAELTKELKKQDEKLSSLEKQLEQKNLDVKRLSNERKEALSAQFAAEATLRRIHSSQKDEEVVPFDAIIAPLESDIKAYRHEIALLQDDKKALERHLKLKEAALVEAGNILRSALERALIVEDVQNQNIELKKQMEIYHEENKLLEKSNRQQVLDIERLTHTIAELEESILSTGDVANAVRFYQNQAAKLNEEKRTLERELARAKVYVNRVASTTANEWKDDADKLMPVKRWLEERRLLQGEIQRLRDKIAMAEKSAKAEAQLNDKLRRKLKALEDDMRNESSNTSASNKDNATSKQATPKRSSSQPRRPIISADGADKRRPASQPRASVSGKVLNKQPGSETEAAEKNRHAAAKRFDSPRSAKSVAAGGRGERPVRSHLWAHRSKVADDAGKENKEQNPNYKAHLGDSHADGDCGVQCSEHEEAMDLRKLDEGKADDSDAVKSTKDSCEI

SEQ ID NO: 105 - protein, 155 aa, Oryza sativa
MAAKLTQEQVDECREIFDLFDSDEDGRIAAGELVTALRSLGQNVDEAEARRFLADATASGGGGGGGGDIDFAAFLSVAARKMRRGATEKELAACLDVFDDARSGVIPAEQLRQAMVSHGDRLTEEEADEMVRKADPAGEGRVEYKEFVKVLMNNK

SEQ ID NO: 106 - protein, 246 aa, Oryza sativa
MAGGGGGGGRGEGEGRAATGKRERIAIRRIDNLAARQVTFSKRRRGLFKKAEELSILCDAEVGLVVFSATGKLFQFASTSMEQIIDRYNSHSKTLQRAEPSQLDLQGEDSSTCARLKEELAETSLRLRQMRGEELHRLNVEQLQELEKSLESGLGSVLKTKSKKILDEIDGLERKRMQLIEENLRLKEQLQVSRMSRMEEMQPGPDSEIVYEEGQSSESVTNASYPRPPPDNDYSSDTSLKLGLHS

SEQ ID NO: 107 - protein, 305 aa, Oryza sativa
MASPAAGTPPFLTKTYAMVEDPSTDETISWNDSGTAFVVWRPAEFARDLLPKHFKHSNFSSFVRQLNTYGFKKVVADRWEFANDCFRRGEKHLLGGIQRRKGSGTGGAGAAPAGGIPTAIPISSPPTSSGGEPAVSSSPPRGAAGIAAGVSGAVAELEEENARLRRENARLARELARARRVCDGVRRLVSRYDHDHGGGEEEAGEGDVKPMLFGVAIGGKRSREENGEDEEEEEEEGADEDGEDDEVEEDDEERERHAARRVPVREGKVRRTTELSDLDVLALSVRAAAAARPGGASRDRKSSVS

SEQ ID NO: 108 - protein, 608 aa, Oryza sativa
MADGVEEGNAVAPRGPARRRGTVRASLDADEFIALMHGSDPVRVELTRLENELRDKERELGEAQTEIRALRLSERAREKAVEELTDELEKMFEKLKLTESLLDSKNLEVKKINDEKKAAMAAQFAAEATLRRVHAAQKDDDMPPIEAILAPLEAELKLARQEIAKLQDDNRALDRLTKQKEAALLDAERTVEIAMAKAAMVDDLQNKNQELMKQIEICHEENKILDKLQRQKVAEVKKLSLTVKELEEAVLRGGATANVVRDYQRQVQEVNDQKKTLECELARAKVTANRVAVVVANEWKDSNDKVMPVKQWLEERRFLQGEMQQLRDKLAVAERTARSEAQLKEKYQLRLKVLEDGLRGPPSGSSRLPTEGKSFSNGPSRRLSLGGADNMSKLSPNGLLARRSPSFHSRSSLSSSSSLVLKHAKGTSKSFDGGTRSLDRSKINGNGAHLLNRSTDAVRDCETNDSWKGNADEGTIENTNSNTDESNKETANNKSAEMVSGFLYDMLQKEVISLRKACHEKDQSLKDKDDAIEMLAKKVDTLTKAMEVEAKKMRREVAAMEKEVAAMRVDKEQEVKARRLGSSKGTGSSQVLSGSRSSSRSGLTRNYQ

SEQ ID NO: 109 - protein, 1045 aa, Sus scrofa
MATPAGLERWVQDELHSVLGLSERHVAQFLIGTAQRCASAEEFVQRLRDTDTLDLSGPARDFALKLWNKVPRKAVAEKPARAAEREARALLEKNRSYRLLEDSEESSEEAVGRAGSSLQKKRKKRKHLRKKRQEEEEEEEEEEVPEKGKKTTGGNKPQTEKPESEDEWERTERERLQDLEERDAFAERVRQRDKDRTRNVLERSDKKAYEEAQKRLKMAEEDRKAMVPELRKKSRREYLAKREREKLEDLEAELADEEFLFGDVELSRHERRELKYKRRVRDLAREYRAAGEQEKLEATNRYHMPEETRGQPTRAVDLVEEESGAPGEEQRRWEEARLGAASLKFGARDAASQEPKYQLVLEEEETIEFVRATQLQGDEEPAAPPAPTQAQQKESIQAVRRSLPVFPFREELLAAVANHQILIIEGETGSGKTTQIPQYLFEEGYTQKGMKIACTQPRRVAAMSVAARVAREMGVKLGNEVGYSIRFEDCTSERTVLRYMTDGMLLREFLSEPDLASYSVVMVDEAHERTLHTDILFGLIKDVARFRPELKVLVASATLDTARFSTFFDDAPVFRIPGRRFPVDIFYTKAPEADYLEACVVSVLQIHVTQPPGDILVFLTGQEEIEAACEMLQDRCRRLGSKIRELLVLPIYANLPSDMQARIFQPTPPGARKVVVATNIAETSLTIEGIIYVLDPGFCKQKSYNPRTGMESLTVTPCSKASANQRAGRAGRVAAGKCFRLYTAWAYQHELEETTVPEIQRTSLGNVVLLLKSLGIHDLMHFDFLDPPPYETLLLALEQLYALGALNHLGELTTSGRKMAELPVDPMLSKMILASEKYSCSEEILTVAAMLSVNNSIFYRPKDKVVHADNARVNFFLPGGDHLVLLNVYTQWAESGYSSQWCYENFVQFRSMRRARDVREQLEGLLERVEVGLSSCQGDYIRVRKAITAGYFYHTARLTRSGYRTVKQQQTVFIHPNSSLFEEQPRWLLYHELVLTTKEFMRQVLEIESSWLLEVAPHYYKAKELEDPHAKKMPKKTGKTREELG

SEQ ID NO: 110 - protein, 723 aa, Ovis aries
MNPTEAKAIPGSKQLEGPHSPNKKRHKKQAVKTEPEKKSQSTKPSVVHEKKTQEVKPKEHTEPKSQPKHPSDTRSKHAPKEKAVSKSSEQPPSEKSTKPKTKSQDEISGGGKSAVPAVAAAASAEPADKNKESKLLTSAVPVESKPSKPSAKSDMDTALDDLIDTLGEPEETKEDTTTYTGPEVSDPMSSTYIEELGKREVTLPPKYRELLNKEEGIAGPPPDSSKPLGPNDAIDALSSDFTCSSPTADAKKTEKEKSTEEALKAQSAGVIRSAAPPKEKRRKVEEDTMTEQALEALSASLGTRKPRPELDPSSIKEVDEAKAKEEKVKKCGEDEERVPSEYRLKPATDKDGKPLLPEAEEKPKPLSESELIDELSEDFDRSKCKEKQSKPTEKNRGIPGRCPRACARGCASDLHVFCAVSSTHSSSSEGMVPDDAVEALAGSLGKKEADPEDGKPVEDKVKEKAKEEDREKLGEREETIPPDYRLEEAKDKDGKPLPPKEVKEPLPPLSEDFLLDALSKDFTVPSDTSSPQFEDAKLSVVVSEVVSQTPAPTTQAAGPPRDSARDNKELDDALDQLSDSLGQRQPDPDEHKPVEDKVKEKAKAEHRDKLGERDDTIPPKYQHLLDDNKEGTPGKPKRSESPRHQRSPRHQRNLQVPRTPLTPSQGTWTAVPQLQKPQQTQQRTKTRSLLPSDKAPRNGGKAKDSTKAKEETSKPKADGKSTS

SEQ ID NO: 111 - protein, 278 aa, Ovis aries
MRIAVICFCLLGIASALPVKPTSSGSSEEKQLNNKYPDAVATWLKPDPSQKQTFLEPQNSVSSEETDDNKQNTLPSKSNESPEQTDDLDDDDENSQEVNSDDSDDAETPDDSDHSNESHHSDESDEADFPTDIPTIAVFTPPFPTESTNDGRGDSVAYGLKSKSKKFRRSNVESPDATEEDFTSHIESEEMHDAPKKTSQLTDHSEETNSDELPKELTPKAKEESKHSNRIESQENSKLSQEFHSLEDKLDLDHKSEEDKRLKIRISHELDSVSSEVN

SEQ ID NO: 112 - protein, 148 aa, Oryza sativa
MGGKELSEEQVASMREAFSLFDTDGDGRIAPSELGVLMRSLGGNPTQAQLRDIAAQEKLTAPFDFPRFLDLMRAHLRPEPFDRPLRDAFRVLDKDASGTVSVADLRHVLTSIGEKLEPHEFDEWIREVDVAPDGTIRYDDFIRRIVAK

SEQ ID NO: 113 - protein, 559 aa, Triticum aestivum
  MOD_RES (284)..(284): Any amino acid
MDDDFDIPAGDDMMMGDGMGDFGGAEGPGMKVGEENEIGKQGLKKKLLKEGEGWDTPEVGDEVEVHYTGTLLDGKKFDSSRDRDDTFKFKLGQGQVIKGWDQGIKTMKKGENALFTIPPELAYGESGSPPTIPANATLQFDVELLSWTSVRDIAKDGGIFKKILKEGDKWENPKDPDEVFVKYEARLEDGTVVSKSEGVEFTVKDGHLCPALAKAVKTMKKGEKVLLAVKPQYGFGEMGRPAAGEGGAVPPNASLVIDLELVSWKTVTEIGDDKKILKKVLKEXEGYERPNEGAVVTVKITGKLQDGTVFLKKGHDEQEPFEFKTDEEAVIEGLDRAVLNMKKGEVALVTIPPEYAYGSTESKQDAIVPPNSTVIYEVELVSFVKDKESWDLNNSEKIEAAGTKKEEGNALFKSGKYARASKRYEKAAKFIEYDTSFSEDEKKQSKQLKITCNLNNAACKLKLKDYKQAEKLCTKVLELDSRNVKALYRRAQAYTQLADLELAEVDIKKALEIDPENRDVKLTYKTLKEKIKEINKKDAKFYSNMFSKMTKPSAEESKA

SEQ ID NO: 114 - protein, 271 aa, Sus scrofa
MSDEEVEHVEEEYEEEEEAQEEAPPPPAEVHEVHEEVHEVHEPEEVQEEEKPRPKLTAPKIPEGEKVDFDDIQKKRQNKDLMELQALIDSHFEARKKEEEELVALKERIEKRRAERAEQQRIRAEKERERQNRLAEEKARREEEEAKRRAEDDLKKKKALSSMGANYSSYLAKADQKRGKKQTAREMKKKVLAERRKPLNIDHLSEDKLRDKAKELWDALYQLEIDKFEYGEKLKRQKYDIINLRSRIDQAQKHSKKAGTTPKGKVGGRWK

SEQ ID NO: 115 - protein, 258 aa, Solanum lycopersicum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEATPKPDDNE

SEQ ID NO: 116 - protein, 647 aa, Oryza sativa
MDSAVRPPVDAEEARRRRSTDCIYFLASPLTCKKGSECEYRHSDAARMNPRDCWYWFNGNCANPKCSFRHPPLDGLVGAPTTPRTSQQSAPQVSVPAQAPVPNPASGTAKQGVPCYYFQKGMCVKGDRCAFLHLPQATGSPAPQHTTKVFAPASVPHPQLKNSWTKPNSSAQQNAPPAIFDKPKDSAHNGKTAQKQNLTNRAGHSSGIIHDKKGSYMPSGVTKNYRPPPSTGDDLAENGVEMGEFVREPSPGSDVLTGGADDNTEQSLREDRGAYRRTNGEQHIGMLRQTHDSYGFERSHRGSAEKLLSESRFSQREPMPLTADSSDLRQRLLKQRRLNNPRSGQVSDRHNVYPEDERHDRHRQRGEEQASNDGVSSSRLRGRIRLPAETTFDRLGLQPEKERDRGPRARLSPPSQTDLRGKLHDRLKAKPNEDVSGNVQSSLSKANEDAESLNFAGPKSLAELKAKKVAGSLMKSSRSLTGPVRMTSEIVTIKDSSDPVLFDGPKPLNAILKRKREADSGNATDFGSKREEHSGGDEEGSQNDFRNIEDDIVGMNTEGNGEEAFQPEDDVVYGDSLSPADDIAAEAADDASRELEEQQDVETAEEYDYEMDDVNAAEENDYQEYEDEDDDLEDDDDFARKVGVMIT

SEQ ID NO: 117 - protein, 387 aa, Sus scrofa
MEVLAAETISQQERLQAIAEKRRRQAEVENRRRQLEDDRRQLQHLKSKALRERWLLEGTPSSASEGDEDMRKQMQEDEQKARLLEESIARLEKEIEELENADTLPAPVKETQVAPSPGPVVPAPCPAQEDRKAEVDLNAQQTPVGTPKEKRISNTPMRMVEGSTMMNAAMYSVEITVEKDKVTGETRVLSSATVLPREHPPQGIKVYEDETKVVHAVDGTAENGIHPLSSSEVDELIHKADEVTLSEAGSAAAPETRGPSEEVVRTTPSRREITGVQAQPGEATSGPPGIQPGQEPPVTMIFMGYQNVEDEAETQKVLGLQDTITAELVVIEDAAEPKEPAPPNGSAAEPLATEGSREENQVGPEAPASDPQDLDMKKQRCKCCSIM

SEQ ID NO: 118 - protein, 258 aa, Solanum tuberosum
MASPREENVYMAKLAEQAERYEEMVEFMEKVVAAADGAEELTVEERNLLSVAYKNVIGARRASWRIISSIEQKEESRGNEDHVASIKEYRSKIESELTSICNGILKLLDSKLIGSAATGDSKVFYLKMKGDYHRYLAEFKTGAERKEAAENTLSAYKAAQDIANAELAPTHPIRLGLALNFSVFYYEILNSPDRACNLAKQAFDEAIAELDTLGEESYKDSTLIMQLLRDNLTLWTSDMQDDGTDEIKEAAPKPDNNE

SEQ ID NO: 119 - protein, 548 aa, Oryza sativa
MADDHAAAADLVDGGRPEGDTHSREDGLSKPRDKDREREKDKDRERHRDRDRDRGRDRDRDKDKEKDRDKERDRDRDRDKDRDRHHRHHRERREHRDRSDDHDRHRSRDSERRRDHERDGRRRHRSRSRSRSRGRDRRSRSRSRSKSKRVSGFDMAPPAQAVVPQFPAIPTPSQFPGTAIPGMFPNMLPMGVGQFNPLVIQPQAMTQQATRHARRVYVGGLPPTANEQSVAIYFNQVMAAIGGNTAGPGDAVLNVYINHDKKFAFVEMRSVEEASNAMALDGILFEGAPVKVRRPTDYNPSLAAALGPSQPSPNLNLAAVGLTPGSAGGLEGPDRIFVGGLPYYFTEAQVRELLESFGPLRGFDLVKDRETGNSKGYAFCVYQDLNVTDIACAALNGIKMGDKTLTVRRANQGAAQPRPEQESILLQAQQQVQLQKLVYQVGALPTKVVCLTQVVSADELKDDEEYEDIMEDMRLEAGKYGNLIKVVIPRPDPSGLPVAGVGKVFLEYADVDGATKAKTAMHGRKFGGNPVVAVFYPENKFSSAEYDA

SEQ ID NO: 120 - protein, 543 aa, Triticum aestivum
MADDNGGGGDDYVSEAVRPEGDTHTREEGLSKSRDRDREKDKDKERHRDRDRDRGRDRDRGRDRDLDKDRDRDKDRDRHQRHHRDKREHRDRPDDHDRHRSRDSERRRDRERDGHRRHRSRSRSRSRGRDDHRSRSHSKSKRVSGFDLGPTAQSVLPQFPTIPTPSQLPGSSIPGMFPNMLPFADGQINPLVMQPQAMTQQATRHARRVYVGGLPPSANEQSVAIYFNQVMAAIGGNTAGPGDAVLNVYINHDKKFAFVEMRSVEEASNAMALDGILFEGAPVKVRRPTDYNPSLAAALGPSQPSSNLNLAAVGLTPGSAGGLEGPDRIFVGGLPYYFTEAQVRELLESFGPLRGFDLVKDRETGNSKGYAFCVYQDLNVTDIACAALNGIKMGDKTLTVRRANQGSAQPRPEQENILLQAQQQVQLQKLVYQVGALPTKVVCLTQVVTADELKDDEEYEDIMEDMRLEAGKYGNLVKVVIPRPHPSGEPVSGVGKVFLEYADVDGSTKAKTAMHGRKFGGNPVVAVFYPENKFADEDYDAAA

SEQ ID NO: 121 - protein, 736 aa, Oryza sativa
MKRAADGMEKPKFLTREEREKLALERRQAAVTDQRRSALDLLQSLPRPPPPPPPPLSNPPRDSSSSHHRDSSDRDRDRDRDRDRDRDRDRDRERRRDDDSRRDRDRDRDRDRGDSSRRDRDRERGDRDRDRDRERGDRDRERGDREKDRLEKMAEREREKELDAIKEQYLGSKKPKKRVIKPSEKFRFSFDWENTEDTSRDMNSLYQSPHEARLLYGRGFLAGIDRREQKKVAAAHEKETRAEQRRKAGLDDRPEDDAVDKKEADAAAKYDAFDMRVDRHWTQKSLDEMTERDWRIFREDFNISYKGSKVPRPMRKWSESKLGTELLRAVEKAGYKEPSPIQMASIPLGLQQRDVIGIAETGSGKTAAFVLPMLSYITRLPPISEENEAEGPYAVVMAPTRELAQQIEEETVKFATYLGIKVVSIVGGQSIEEQGFKIRQGCEVVIATPGRLLDCLERRYAVLNQCNYVVLDEADRMIDMGFEPQVVGVLDAMPSSNLKPENEDEELDAKTIYRTTYMFSATMPPAVERLARKYLRNPVVVTIGTAGKATDLITQNVIMTKESEKMSRLQKILTDLGDKPAIVFCNTKKSADARAKDLDKAGFRVTTLHGGKSQEQRETSLDGFRNRRFTVLVATDVAGRGIDIPDVAHVINYEMPSSIDTYTHRIGRTGRAGKKGLATSFLTLENTDIFFDLKQMLIQSNSPVPPELARHEASKFKPGSVPDRPPRRNDTVYATH

SEQ ID NO: 122 - protein, 319 aa, Sus scrofa
MMVLKVEELVTGKKNGGGDAGEFLPEDFRDGEYEAAVTLEKQEDLKTLPAHFVSLGEQQWKIEKEREAELKKKKLEQRSKLENLEDLEIIIQLKKRKKYRKTKVPVVKEPEPEVITEPVDVPRFLKAALENKLPVVEKFLSDKNNPDVCDEYKRTALHRACLEGHLAIVEKLIEAGAQIEFRDMLESTAIHWASRGGNLDVLKLLLNKGAKISARDKLLSTALHVAVRTGHYECAEHLIACEADLNAKDREGDTPLHDAVRLNRYKMIRLLITYGADLNVKNCAGKTPMDLVLNWQNGTKAIFDSLKENSYKASRIATF

SEQ ID NO: 123 - protein, 287 aa, Ovis aries
MSDVEETVDEYEEQEEAAVEEHEESVEEEAGGEARQGGGASAAEDGEEEEGREAEDGPVEESKPQAPGPFMPNLVPPKIPDGERVDFDDIHRKRMEKDLNELQTLIEAHFENRKKEEEELVSLKDRIEKRRAERAEQQRIRTEREKERQARLAEERARREEEESRRKAEDEARKKKALSNMMHFGGYIQKAQAERKSGKRQTEREKKKKILAERRKVLAIDHLNEDQLREKARELWQSIYDLEAEKFDLQEKFKQQKYEINVLRNRVNDNQKVSKTRGKAKVTGRWK

SEQ ID NO: 124 - protein, 711 aa, Oryza sativa
MEADGAAAAAAAGEASTEAGARPLAPEEEALRRNTDCVYFLASPLTCKKGNECDFRHSDNARMNPRDCWYWLNSNCLNPKCPFRHPPIDGMFGAPTTGMPAVSSHYAPFNSGKQLVPCYYFKKGNCLKGDRCAFYHGPQSVGNNPSEQVVKVSSLPLEQLQTQKNDLLGIKDSVQSTNSIQHGAPITNERGKTAVDRSTVNSARTATVAIPVASNAMSCPKSEKVKSSTPAALKESFTTSSGGDHPECYQNHFPMDSDPVRDWNQSYEMPPADDLPQNSREADELLGESSPGFDVLVDNDADGAAYLHDEDFGGDMYPVEDYEYAPADFDVRAHHERERFNGMDEQDQMGHMYDGYERKRRRSSERSMERPFHSERRFLQRDRDRVEMDGSDLRHRLRRRRINESSLAISPERNGEQRRRDERYRERAHGHRSHRDHHQSSRGSTLSSRLQGRIKLPGRSPDRVDTRSEKERDRRRLRDRLSPVRRTEFQGTRHREAGQHEEQTQRRSSELALGSRNADGQHLTKDVPDSHNFPHRKNSRDSSKANGSVEPEASLDFEGPKPLSVILQRKREAAWANGTSACSPKQDKSAEVSHRQASLAEAEKEGDNIISSDEYKSGSGDEEFRDEGHIPVEGHGQSSSHGDKLEAEDIIEVDPVENQDADNYDQREGESYYEPIEGQDYKSDDENAYEDDDEEYDDDDDFARKVGVVFS

SEQ ID NO: 125 - protein, 155 aa, Oryza sativa
MAPKAEKKPAAKKPAEEEPAAEKAEKAPAGKKPKAEKRLPAGKGEKGSGEGKKDRAGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 126 - protein, 1810 aa, Oryza sativa
MGDGERREDENPTTSAADDDDDEDYDEPGGGNHFLGFMFGNVDDSGDLDADYLDEDAKEHLFALADKLGPSLKDIDLIKPSAAPTDPSEQDYDAKAEDAVDYEDIDEEYDGPEVEAATEEDHLLSKKDYFSSNAVYASVNSKVSVFDEENYDEDEEPPNDNDLPSDNIVQNCTSASAEQLDMAPSNDNLAVEKMSSSLSEPEESFESEAFQKEMVAEEQLESKTATSLPVLCIEDGSVILKFSEIFGAQEPVRKAKMDRHKRPVNKELQITNFTDIVEEDEEVFLRSTIQNLSALKHIKTNDNFVESDSDESTSDVALRLKDSCLSEQPMKDKDIPTAVQSPVFPDFYPLEHENWENDIVWGNSPTTAIQPCLTSCAISKESLDDHNEDQAEGYVSGCWDVQNKFHSSSVMADPFGHTEIPDSTSYRSPENSYSPLRKETAQENNSLDEPNNITQPVKIDTTRHLNKLSLLNKELLEGSWLDNIVWDPSEDVPKPKLIFDLKDDHMLFEILDEKNGDHLRSHARAMIVTRPMKTSAVENVDHNNQAIALSGRFNISNDKFYSNRKMSQQARSHAKKRATMGLKLVHSVPAQKLQTMKPKLSIKEIANFHRPKAKWYPHENKLTARFQGDECSHGPMTAIVMTLGGKGVKFLVNAEETPLSVKSKASKKLEFKPSEKIKLFCSGKELQDDISLAMQNVRPNSILHVVRTEIHLWPKAQRLPGENKPLRPPGAFRKKSDLSVKDGHVFLMEYCEERPLLLANAGMAARLCTYYQKTSPSDQTATSLRSNSDGLGTMLAIDPADKSPFLGNIRSGSHQSCLETNMYRAPVFPHKVATTDYLLVRSPKGMLSLRRIDKLYAVGQQEPHMEVFSPGTKNMQNYILNRILVYVYREFRAREKPGIIPQIRADELPIQPPITEAIVRKRLKHCADLRKGPKGHLFYIQRPDFRIPSEEELRRLLTPENVCCYESMQAGQYRLKHLGIEKLTQPVGLASAMNQLPDEAIELAAAAHIERELQITSWNLTSNFVACTNQDKENIERLEITGVGDPSGRGLGFSYVRVTPKAPVSNSTHKKKSAAAKGTTVTGTDADLRRLSMDAARELLLKFGVPEEQIDKLTRWHRIAMVRKLSSEQAASGVTMDEIPVSKFARGQRMSFLQLQQQTKEKCQEIWDRQIQSLSAMDGNENGSDTEANSDLDSFAGDLENLLDAEEFDDEDVGNTDIRSDKMDGMRGLKMRRCHTQSQINEEIQDDVAEAALVEKLLEESDSDMKRKKQPVETTNYSTPMYNQGNKMKQGKAGQMIKSSVYAGALTPKESIPREAKEVENFAEGSLPSKLRTKTGFDANDDIILVKRKNIPGKDGFKEKRQGARGDTLVCGACGQLGHMRTNKLCPKYGEDPETSEMDVNSIRSHPPDIVSNAQIKTSNKRLVAKVSSEAFETEGPESIEKAKPVPVKFKCGAPEKSLDRNMSISASLVSDKRMMDATDSKSTGKVNKIKISNKIKYDDYPPDTPKPSVVIRPPAEVEKDLPRKKIIIKQPKVLGDQQRPTELRSGQEPRKTRKIVELSSFEKRDREDDNGFSGQPIQINSSHDRGWGLVGKRSKGIMESSESWRAFEEQRERQEQRLIEARIYDARREDELQKAKKKNKKKKKHEFRDDDLLDPRPYKNDRRVPERGRAAKRRTPADMTEYTPPAKRHRGGEVELSNILEKIVDHLRTMSCSFLFRKPVTKKEAPDYFDIIERPMDLGTIRDKVRKMEYKNREDFRHDVAQIALNAHTYNLNRHPHIPPLADELLELCDYLLEESADVLDDAEYAIED

SEQ ID NO: 127 - protein, 155 aa, Oryza sativa; identical to SEQ ID NO: 125

SEQ ID NO: 128 - protein, 1254 aa, Sus scrofa
MEDGKPVWAPHPTDGFQVGNIVDIGPDSLTIEPLNQKGKTFLALINQVFPAEEDSKKDVEDNCSLMYLNEATLLHNIKVRYSKDRIYTYVANILIAVNPYFDIPKIYSSETIKSYQGKSLGTMPPHVFAIADKAFRDMKVLKLSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIRERLHLSSPDNFRYLNRGCTRYFANKETDKQILQNRKSPEYLKAGSLKDPLLDDHGDFIRMCTAMKKIGLDDEEKLDLFRVVAGVLHLGNIDFEEAGSTSGGCNLKNKSTQALEYCAEKLLGLDQDDLRVSLTTRVMLTTAGGAKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEARLVGILDILDEENRLPQPSDQHFTSAGHQKHKDHFRLSIPRKSKLAIHRNIAYDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGFPSRASFHEVYNMYKKSLPDKLARLDPRLFCKALFKALGLNEIDYKFGLTKVFFRPGKFAEFDQIMKSDPDHLAELVKRVNHWLICSRWKKVQWCSLSVIKLKNKIKYRAEACIKMQKTIRMWLCKRRHKPRIDGLVKVGTLKKRLDKFNEVVSALKDGKQEMSKQVKDLEISIDALMAKIKSTMMTREQIQKEYDALVKSSAVLLSALQKKKQQEEEAERLRRIQEEMEKERKRREEDEQRRRKEEEERRMKLEMEAKRKQEEEERKKREDDEKRIQAEVEAQLARQREEESQQQAVLEQERRDRELALRIAQSEAELISDEAQADPGLRRGPAVQATKAAAGTKKYDLSKWKYAELRDTINTSCDIELLAACREEFHRRLKVYHAWKSKNKKRNTETEQRAPKSVTDYAQQNPAVQLPARQQEIEMNRQQRFFRIPFIRSADQYKDPQNKKKGWWYAHFDGPWIARQMELHPDKPPILLVAGKDDMEMCELNLEETGLTRKRGAEILPRQFEEIWERCGGIQYLQNAIESRQARPTYATAMLQNLLK

SEQ ID NO: 129 - protein, 884 aa, Oryza sativa
MGSTGEPDRKRRLSSSVAPGGGAPVSPAKRLAVAPTSEDKKLDFTVLKYKNQKLSEQLEAHKFEYRALENKFAGLKEKQRTHNETLSLVNSSWEQLVADLKSRSFCKSGSPNSSPGSGHNNVQKDGTCAPIERDTLRSLVESGATESSGCLPGCHLGSDAPPLHLSTANALGDIFFPSSDLLQANEECALAALTKLPENDRSKQLQSTSSNLLSSLNNVVQALSNLQLKHKQLAEDYQNQRDSSARKRAEHRRLKEELASAASELEETNYKLAALKAQRDNTQGARIPYPTLGNKNMPEDKVRDKQREMQDLEATHKELSELISKRLVEIKRLHEERIEILNKIATFQNILMDFKSIRSSKAFQLVNDRLQKSQAELDHYQTLLEKLQVDKDKFVWQERQFNLKVDLAEIPERVSTYCESSIADLKKDIQKLCDEKNMLILKLEEASREPGRNQVITKFKALVSSIPREMGAMQSEMTKHKEASLELNSLRAEVHSLSRILSRKERDNEEASCRSARAGSDITQLQSVISDLKQTNKELKLFADMYKRESTDSREIMESRDREFLEWAHVHALKSSLDESKLEQRVKAANEAEAITQQRLATAEAEIAESGQKLGTSRKDLVSLSHMLKSKQEECEAYRVEVECIGQAYEDIQAQNQQLLQQIIERDDDNTKIFMEGVKAKQTQDALHLETYSLRRNLQQESSLMDLYNQKIVSLEDQLKMWSDRVGKLQEDGWQQSVSLSNYQRKLVDVHRDAQKLMQSLDGIQANVGSSRLEVADLLIELEKERFSKKRIEDDLEVMSRKASSLRAKARESAVLEKLRHEVKEYRGILKCGICHDRQKEVVITKCYHLFCNQCIQKSLGNRQRRCPSCSLSFGANDVKPIYI

SEQ ID NO: 130 - protein, 884 aa, Oryza sativa
MGSTGEPDRKRRLSSSVAPGGGAPVSPAKRLAVAPTSEDKKLDFTVLKYKNQKLSEQLEAHKFEYRALENKFAGLKEKQRTHNETLSLVNSSWEQLVADLKSRSFCKSGSPNSSPGSGHNNVQKDGTCAPIERDTLRSLVESGATESSGCLPGCHLGSDAPPLHLSTANALGDIFFPSSDLLQANEECALAALTKLPENDRSKQLQSTSSNLLSSLNNVVQALSNLQLKHKQLAEDYQNQRDSSARKRAEHRRLKEELASAASELEETNYKLAALKAQRDNTQGARIPYPTLGNKSMPEDKVRDKQREMQDLEATHKELSELISKRLVEIKRLHEERIEILNKIATFQNILMDFKSIRSSKAFQLVNDRLQKSQAELDHYQTLLEKLQVDKDKFVWQERQFNLKVDLAEIPERVSTYCESSIADLKKDIQKLRDEKNMLILKLEEASREPGRNQVITKFKALVSSIPREMGAMQSEMTKHKEASLELNSLRAEVHSLSRILSRKERDNEEASCRSARAGSDITQLQSVISDLKQTNKELKLFADMYKRESTDSREIMESRDREFLEWAHVHALKSSLDESKLEQRVKAANEAEAITQQRLATAEAEIAESGQKLGTSRKDLVSLSHMLKSKQEECEAYRVEVECIGQAYEDIQAQNQQLLQQIIERDDDNTKIFMEGVKAKQTQDALHLETYSLRRNLQQESSLMDLYNQKIVSLEDQLKMWSDRVGKLQEDGWQQSVSLSNYQRKLVDVHRDAQKLMQSLDGIQANVGSSRLEVADLLIELEKERFSKKRIEDDLEVMSRKASSLRAKARESAVLEKLRHEVKEYRGILKCGICHDRQKEVVITKCYHLFCNQCIQKSLGNRQRRCPSCSLSFGANDVKPIYI

SEQ ID NO: 131 - protein, 230 aa, Oryza sativa
MVRGKTQMKRIENPTSRQVTFSKRRNGLLKKAFELSVLCDAEVALIVFSPRGKLYEFASASTQKTIERYRTYTKENIGNKTVQQDIEQVKADADGLAKKLEALETYKRKLLGEKLDECSIEELHSLEVKLERSLISIRGRKTKLLEEQVAKLREKEMKLRKDNEELREKCKNQPPLSAPLTVRAEDENPDRNINTTNDNMDVETELFIGLPGRSRSSGGAAEDSQAMPHS

SEQ ID NO: 132 - protein, 725 aa, Oryza sativa
MAPPPLHLFSPHVPSTSVSPPDPATEAPPAPKQHRGPRPAPRNPGSAKPLTAGVPGGRTRRAVLGIIRKVRSLELSDPRTPSPNGGGGSSSSSTATARVPFHLPIHPPPPEREEEEEKKGIRRAVPWAAARDEETKVVLRREKKTRVPTRAETELEAGELERLRRAARGKERWARAKKAGITDEVVEEVRGQWAKGQELAGVRIVEPLRRCMDRAREILEIKTGGLVVWTRGGIHFVYRGSSYLENAKRHRDFVNYNEELSPVTSNNPTSQGKYWSKDETLTNDNDEADDKDDKPIKGTLYEREVNRLLDSLGPRFIDWWWNTPLPVDADLLPEVVPDFKTPFRQCPPGVRPALADEELTYLRKHARPLPTHFVLGRNTKLQGLAAAILKLWEKSLIAKVAVKVGIQNTNHEQMARNLKRLTGGTVILRNKDYIIIYRGKDFLPGGVAESVIERESQVHDQQAKEEEARLKMADSLQMIVGLSSERSYVGTFREYQDFHDSHARRTTENNFRIQLEAKKHRLEKELKDQEWRLSMLTKKIERSNQVLAKLHSSWSPSKKDGDRELLTEEERRIFRKIGLKMDEHVLLGRRGVFEGVIEEIHQHWKHKEVVKVITKQNQASQITYTSMMLEVETGGTLIAIERFTTSHAIILYRGKNYRRPTKSAPSNLLTKREALQRSIEVQRRGSMKYFAQERKKSIDELKRELRNVTWEIRKLNHDTEQSWTA

SEQ ID NO: 133 - protein, 582 aa, Oryza sativa
MGGRARSILRWLRHHRSRRVSSSSFHLTTTGDDTVKDLHDPRREDAEGDGWEEVHEGPESDPEEYIALVSEDAGTHLPVRTEPRRMDPSKKEPDFFTEYGEANRYKVSEVIGKGSYGVVAAAVDTQTGERVAIKKINDVFDHVSDATRILREIKLLRLLRHPDIVEIKHIMLPPSRREFRDIYVIFELMESDLHQVIKANDDLTPEHHQFFLYQLLRGMKYIHAASVFHRDLKPKNILANADCKLKVCDFGLARVSFNDTPSAIFWTDYVATRWYRAPELCGSFFSKYTPAIDIWSVGCIFAELLTGKPLFPGKNVVHQLDLMTDLLGTPSAESLAKIRNEKARRYLSNMRKKPRVPFTKKFPGVDPMALHLLERLLAFDPKDRPSAEEALTDPYFNGLANSEREPIAQPISKLEFEFEKRKLAKDDVRELIYREILEYHPHMLQEYLRGGDQMSFMYPSGVDRFKRQFAHLEEGVSKGEKSSPQLRQNASLPRERAIGNKHGDDEYHAKLNVGEKPCHASVTDGISKPLMSARSLLKSESISASKCIGEKPKQDRDQEDSLTESMDETADEVSEKVAQLKT

SEQ ID NO: 134 - protein, 333 aa, Oryza sativa
MSGFGDGYVGTAQDAVKIRRLEKQREAERRKIEELKNKSSDGQPGLLQFGSSTSEILETAFKKETVGLVTREQYVEKRVNIRTKIEEEEKEKLQKLQQEEEELQMQKRKKRRVRGDPRLSFCDEIENGSDEDEFENQEPQKKHGPVKLGKDPTVETSFLPDREREAEEQAERERLKKQWSREQELIKNEPLTITYSYWDGTGHRRVIQVRKGDSIGEFLRAVQQQLAPEFREVRTTSVENLLYVKEDLIIPHQHSFYELIINKARGKSGPLFHFDVHEDVRTIADATKEKDESHAGKVVERHWYEKNKHIFPASRWEIYDPTKKWERYTIHGD

SEQ ID NO: 135 - protein, 333 aa, Oryza sativa; identical to SEQ ID NO: 134

SEQ ID NO: 136 - protein, 252 aa, Solanum lycopersicum
MEKEREKQVYLARLAEQAERYDEMVEAMKAIAKMDVELTVEERNLVSVGYKNVIGARRASWRILSSIEQKEESKGHEQNVKRIKTYRQRVEDELTKICSDILSVIDEHLVPSSTTGESTVFYYKMKGDYYRYLAEFKAGDDRKEASEQSLKAYEAATATASSDLAPTHPIRLGLALNFSVFYYEILNSPERACHLAKQAFDEAIAELDSLSEESYKDSTLIMQLLRDNLTLWTSDLEEGGEHSKGDERQGEN

SEQ ID NO: 137 - protein, 233 aa, Oryza sativa
MVRGRTELKRIENPTSRQVTFSKRRNGLLKKAFELSVLCDAEVALIVFSPRGRLYEFASAPSLQKTIDRYKAYTKDHVNNKTIQQDIQQVKDDTLGLAKKLEALDESRRKILGENLEGFSIEELRGLEMKLEKSLHKIRLKKTELLEQQIAKLKEKERTLLKDNENLRGKHRNLEAAALVANHMTTTTAPAAWPRDVPMTSSTAGAADAMDVETDLYIGLPGTERSSNRSETG

SEQ ID NO: 138 - protein, 574 aa, Sus scrofa
MSHQPLSCLTEKGDSPTETTGNGPPTLAHPNLDTFTPHELLQQMRELLIENHQLKEAMKLNNQAMKGRFEELSAWTEKQKEERLFFETQSKEAKERLTALSLENEKLKQELGKLKGKTERSFEDLTGDPRVPKAEAEQEVEQLKTQVARLQAEKADLLGIVSELQLKLNSGGPSEDSFVEIRMAEGEADAAMKEIKTSPGPIRTDSIDTSKSAEGTRNYLEFEELTVSQLLLCLREGNQKVERLEIALKEAKERILDFEKKAKDRSETETQTEEHKEQEKEEEKSPETVGSEVEMLNLQVTTLFKELQEAHTKLSEAELMKKRLQEKCQALERKNSATPSELNEKQELLYNNKKLELQVESMRSEIKMEQAKTEEEKSKLTTLQLTHNRLLQEYNNALKTIEELKRRESEKVDKVVLQELNGKLEMAEKALASKQLQMDEMKQTIAKQEKDLETMAVLRAQMEVYCSDFHAERAAREKIHEEKEQLALQLAVLLKDDNAFEEGASRQSLMEMQSRHGARASDADQQAFLVQRGAEDRNWLQQQQQNIPIHSCPKCGEVLPDIDTLLIHVTDCII

SEQ ID NO: 139 - protein, 258 aa, Sus scrofa
MASTKERENFVYVAKLAEQAERYEEMVEAMKNVANLNVELTVEERNLLSVGYKNVVGARRASWRILSSIEQKEEAKGNDVSVKRIKEYRLKVESELSNICSDIMTVIDEYLIPSSSSGEPSVFFYKMKGDYYRYLAEFKSGDERKEAADHSMKAYQLASTTAEAELASTHPIRLGLALNFSVFYYEILNSPERACHLAKQAFDEAISELDTLSEESYKDSTLIMQLLRDNLTLWTSDIPEDGEEQKVDSARADGGDDA

SEQ ID NO: 140 - protein, 155 aa, Sus scrofa
SGSQDLEPSSGLVTDAIADSESEDDEDLDVPIPSRFDRRVSVCAETYNPDEEEEDTDPRVIHPKTDQQRCRLQEACKDILLFKNLDQEQLSQVLDAMFERTVKVDEHVIDQRDDGDNFYVIERGTYDILVTKDNQTRSVGQYDNHGSFGELALMY

SEQ ID NO: 141 - protein, 757 aa, Sus scrofa
MSDSDEYVDLPVSDEEEWEDGESEEDEEKVGSRKKAKVHAKQLKRLQEKDPEFYKYLEECDKELLEFDDDDFDDNEGSAEKHSSVPKEEPKEIVKPITMQMVDSWCQGAEDGKIGSIRSILEAFRKACHYGEESGNNSAPKFSVMSGSVLDKVMHFVLKNMDRILRELLDAPSFGGKKETVSELMITKQWKRHGRLMRLYLVNALHMITELTDEQMVAFTVHRVRASAVFLAAFPALLRKYVKALLHTWSRGRGAMPLVSFLFLRDLCIQLGSECLDTSLKGIYKAYLVNCKLSKSISGSKLQHIQFLGNCVRELYNVDPQSAYQHAFVFIRQLAVILRGALTERGPKTSKDKKQKESIKPTKKRMEKSYQKVYDWQYIFCLELWTSVVCGCSSEEDLRPLAYPLTQIIHGVACLVPSARYFPVRLRCVKMLNRIAEATGTFIPVSSLLLDMLEMKELGGKPDAVGKAVNLFSVKQVDKKTVKTRAFQEACIFSAVDELAKHLAQWSYSIAFFEMSFLTLVRLQNFCKTVKADRFRREIKDLIHQIKASAEFVSSKRAGIGFSPNDPAVDSFLQVEKEAKSSPLSKYVATLHQRSQDRMDSLDDTSVIVGAESSTFSRRLSEAQKRQDEQDDGEDTIAFSKNLLTEKKKTKTPKEKSKKRAHNHDDVATEEDIVEDLILSSDEEDEDEDKNMESDEDDGSMPVEDDSDDDFVDPDSQWKKQKKEKSKKRNKRQPSKKGSSTTKRKEKIPHPKKKAKH

SEQ ID NO: 142 - protein, 138 aa, Sus scrofa
MAPKAEKKPVAEKAEKTTAAKKTKAEKRPPASKEGGDKKGKKKSKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 143 - protein, 60 aa, Triticum aestivum
PGRLRTAYTNTQLLELEKEFHFNKYLCRPRRVEIAALLDLTERQVKLWFQNRRMKHKRQT

SEQ ID NO: 144 - protein, 199 aa, Oryza sativa
MENEFQDGKTEVIEAWYMDDSEEDQRLPHHREPKEFIHVDKLTELGVISWRLNPDNWENCENLKRIREARGYSYVDICDVCPEKLPNYETKIKSFFEEHLHTDEEIRYCLEGSGYFDVRDQNDQWIRIALKKGGMIVLPAGMYHRFTLDTDNYIKAMRLFVGDPVWTPYNRPHDHLPARKEFLAKLLKSEGENQAVEGF

SEQ ID NO: 145 - protein, 124 aa, Salmo salar
MSSGKVKAGELWNKSKDDLTKQLAELKTELGQLRIQKVASSGSKLNRIHDIRKSIARVLTVINAKQRAQLRLFYKNKKYAPLDLRAKQTRAIRRRLSPDEKSRVLEKTKKRTVHFPQRKFAIKA

SEQ ID NO: 146 - protein, 262 aa, Solanum lycopersicum
MSAQAELSREENVYMAKLAEQAERYEEMVEFMEKVAKTVDSEELTVEERNLLSVAYKNVIGARRASWRIISSIEQKEESRGNEDRVTLIKDYRGKIETELTKICDGILKLLESHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDTAEEIREAPKRDSSEGQ

SEQ ID NO: 147 - protein, 119 aa, Oryza sativa
MAKSSFKLDHTLERRQAEANRIREKYSDRIPVIVEKAERSDIPDIDKKKYLVPADLTVGQFVYVVRKRIKLSPEKAIFIFVKNTLPPTAALMSAIYEENKDEDGFLYMTYSGENTFGLL

SEQ ID NO: 148 - protein, 137 aa, Oryza sativa
KPAEKKPAEKTPVAEKAPAEKKPKAGKKLPKDAAAGDKKKKRSKKAVETYKIYIFKVLKQVHPDIGISSKAMGIMNSFINDIFEKLAQEASRLARYNKKPTITSREIQTAVRLVLPGELAKHAVSEGTKAVTKFTSS

SEQ ID NO: 149 - protein, 42 aa, Zea mays
MADKPDMGEINSFDKAKLKKTETQEKNTLPTKETIEQEKQAK

SEQ ID NO: 150 - protein, 46 aa, Oryza sativa
RGPDAPGPASKRVRTAYTSAQLVELEKEFHFNRYLWRRRRVEMANP

SEQ ID NO: 151 - protein, 40 aa, Oryza sativa
ATYNIKLITPEGTKEITCSDSEYILDAAEEKGLDLPYSCR

SEQ ID NO: 152 - protein, 88 aa, Triticum aestivum
MVKLRLKRCGRKQRAVYRIVAIDVRSRREGKDLQKVGFYDPIKNQTYLNVPAILYFLEKGAQPTETVQDILKKAEVFKELRLNQPKFN

SEQ ID NO: 153 - protein, 152 aa, Sus scrofa
MAPKAEKKPAAKKPAEEEPAAEKAEKTPAGKKPKAEKRLPAGKSAAKEGGDKKGKKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 154 - protein, 128 aa, Salmo salar
MQIFVKTLTGKTITLEVEPSDTIENVKAKIQDKEGIPPDQQRLIFAGKQLEDGRTLSDYNIQKESTLHLVLRLRGGIIEPSLRQLAQKYNCDKMICRKCYARLHPRAVNCRKKKCGHTNNLRPKKKVK

SEQ ID NO: 155 - protein, 71 aa, Zea mays
GPDRKRGRQTYTRYQTLELEKEFHFNRYLTRRRRIEIAHALCLTERQIKIWFQNRRMKWKKEHKEEGPAAS

SEQ ID NO: 156 - protein, 221 aa, Salmo salar
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKTPAAKKDNAEGQEVEAAAEETKKSNHVTRKLEKRKEGRTLDPHIEEQFGSGRLLACISSRPGQCGRADGYILEGKELEFYMKKLQRKKGKSAVA

SEQ ID NO: 157 - protein, 260 aa, Solanum lycopersicum
MAAAHTPREENVYMAKLAEQAERYEEMVEFMEKVSANADSEELTVEERNLLSVAYKNVIGARRASWRIISSIEQKEESRGNEDHVAVIRDYRSKIESELSNICDGILKLLDTRLIPSASSGDSKVFYLKMKGDYHRYLAEFKTGAERKEAAESTLTGYKSAQDIANAELPPTHPIRLGLALNFSVFYYEILNSPDRACNLAKQAFDEAIAELDTLGEESYKDSTLIMQLLRDNLTLWTSDMQDDGADEIKEAAPKADEQQ

SEQ ID NO: 158 - protein, 88 aa, Oryza sativa
ADRELKEMLLKKYSGCLSRLRSEFLKKRKKGKLPKDARSALMDWWNTHYRWPYPTEEDKVRLAAATGLDPKQINNWFINQRKRHWKPS

SEQ ID NO: 159 - protein, 82 aa, Oryza sativa
MAMRLAAAAAFVRRLVPARNPVISAEAEAVTCGRGDKKTKRGKRFKGSYGNARPKREKKIERIKDRVEVPRSTPWPLPFKLI

SEQ ID NO: 160 - protein, 36 aa, Triticum aestivum
TKGLVLGIYSKEKEDDAPQFTSAGENFDKWVSGKLR

SEQ ID NO: 161 - protein, 69 aa, Triticum aestivum
  MOD_RES (51)..(51): Any amino acid
EPATGRVIATLTCSGEKEVNLAVQDAKAAFKIWSQKSGMERCRILLEAARXIRERKEEIATMETINNGK

SEQ ID NO: 162 - protein, 248 aa, Sus scrofa
MTENSVPVIKFTQHIVTTNKHVFSEHNEKSNSELQRVVRIILTDADATDSSDDEGRNTVRRVKRHVTEINLMPSTKSIGDRKRRSVSPDSDVTRRKKFRGVRQRPWGRWAAEIRDPTRGKRVWLGTYDTPEEAAVVYDKAAVKLKGPDAVTNFPVSTTAEVTVTVTETETESVADGGDKSENDVALSPTSVLCDNDFAPFDNLGFCEVDAFGFDVDSLFRLPDFAMTEKYYGDEFGEFDFDDFALEAR

SEQ ID NO: 163 - protein, 146 aa, Oryza sativa
MEILGFTVMGGGSPAWIEVPEKSKSAFWELMRRKVHRYVIFKIDDRREEIVVEKTGAPWESYDDFTASLPADAVYDLDFVSDDNCRKSKIFFISWSPSLSCIRAKTIYAVWRNQFRHELDGVHFEIQATDPDDMDLEVLRGRANRT

SEQ ID NO: 164 - protein, 144 aa, Oryza sativa
MPKNKGKGGKNRKRGKNEADDDKRELVFKEDGQEYAQVTRMLGNGRCEAICVDGTKRLCHIRGKMHKKVWIAAGDIVLVGLRDYQDDKADVILKYMNDEARLLKAYGELPDTVRLNEGVDVDGPEEGEGDSDYIQFEDEDIDKI

SEQ ID NO: 165 - protein, 119 aa, Oryza sativa
SGSCEFKTCWKAMPPFRKVGNVLKEKFDGATEVEQSEIGSTKVLVPKNSQFKPHTDEDLVYLDSSPDFCDHDLKNGVLGTSGRQCNKTSKAIDGCELMCCGRGFHTDEVEVVERCSCKF

SEQ ID NO: 166 - protein, 148 aa, Zea mays
MGDFDGEQKELIKKLVNFRMIDGKRTRVRAIVYKTFHRLARTERDVIKLMVDAVDNIKPICEVVKVGVAGTIYDVPGIVARDRQQTLAIRWILGAAFKRRISYRISLEKCSFAEILDAYRKRGISRKRRENLHGLASTNRSFAHFRWW

SEQ ID NO: 167 - protein, 152 aa, Oryza sativa
MAPKAEKKPAEKKPAAGEEKSAEKAPAGKKPKAEKRLPASKASSKEGGAGDKKGRKKAKKSVETYKIYIFKVLKQVHPDIGISSKAMSIMNSFINDIFEKLAQEAARLARYNKKPTITSREIQTSVRLVLPGELAKHAVSEGTKAVTKFTSN

SEQ ID NO: 168 - protein, 103 aa, Ovis aries
MEKSKRLFMKSKRSFRRRLPPIQSGDRIDYKNMGLISRFISEQGKILSRRVNRLTLKQQRLITIAIKQARILSSLPFLNNEKQFEKSESTARTTTLRKKKYRN

SEQ ID NO: 169 - protein, 42 aa, Salmo salar
TYCAEIAHNVSTKKRKEIVERAAQLDIVVPTKLARAPSQEDE

SEQ ID NO: 170 - protein, 324 aa, Meleagris gallopavo
YPNTFWMNPQYLIKLEEEDEDQEDGESGCTFLVGLIQKHRRRQRKMGEDMHTIGFGIYEVPEELTGQTNIHLSKNFFLTHRARERSDTFINLREVLNRFKLPPGEYILVPSTFEPNKDGDFCIRVFSEKKADYQVVDDEIEADLEENDASEDDIDDGFRRLFAQLAGEDAEISAFELQTILRRVLAKRQDIKSDGFSIETCRIMVDMLDSDGSAKLGLKEFYILWTKIQKYQKIYREIDVDRSGTMNSYEMRKALEEAGFKLPCQLHQVIVARFADDQLIIDFDNFVRCLVRLETLFRISKQLDSENTGTIELDLISWLCFSVL

SEQ ID NO: 171 - protein, 66 aa, Sus scrofa
MAKGKDIRVIVILECTGCDKKSVNKESTGISRYITKKNRQNTPSRLELRKFCPRCCKHTIHAEIKK

SEQ ID NO: 172 - protein, 312 aa, Sus scrofa
MKRPTSSSRKSKKQGEDLAFSEEGSLPAVTMEQKDEAEMEEVDDEEEEEVDEDMAGGHAAQSPSPSCGLGEKKRRLALEQVRALERSFDTDNKLDPDRKARIARDLGLQPRQVAVWFQNRRARWKTKQLERDFAALRAQHNDALRADCDALRRDKDALAAEIRELREKLPTKPADTAASVKVEAGNDAAAGAAAATVCKDGSSDDSDSSVVFNDEASPYSGAAFIGFGPSFLVDDASAATVGCSSSLPALESKWHGPYSDDSCKGGVYGFTEEWLAACSGEMAGNDAAGFFSDEHASNLNFGWCASGNEGWE

SEQ ID NO: 173 - protein, 66 aa, Triticum aestivum
HEKELIEALQEVLKKLKSKRIPIYEKKYGQVPMCDAGEQCAVRKGARIGKLCDCPRGTSCNSFLLK

SEQ ID NO: 174 - protein, 155 aa, Sus scrofa
MSSKLNALFSDSYVDVSQYRDQHFKGNRYEQEKLLKQANTLYVGNLSFYTTEEQVYELFSKSGDVKRIIIGLDKVKKTACGFCFVEYYTRTDAENAMRFVNGTRLDDRIIRTDWDAGFKEGRQYGRGKSGGQVRDEYRQDYDPARGGYGKVVSRP

SEQ ID NO: 175 - protein, 66 aa, Salmo salar
MAKGKDVRIRVILQCVSCVRKGANEESAGISRYSTQKNRHNTPGQLELRKFCRYCRKHTIHAEIKK

SEQ ID NO: 176 - protein, 110 aa, Oryza sativa
MDKSKRLFVKSKQSIRRSSPLIQSGDRIDYKNLSLLFKFISRQGKILSRRVNKLTLKQQRLITIAIKQARILSLLPFVNSSSFVNNAKKKYEKRKSITRTRTPVLKKKKK

SEQ ID NO: 177 - protein, 115 aa, Ovis aries
MEEEKHHHHHLFHHKDKAEEGPVDYEKEIKHHKHLEQIGKLGTVAAGAYALHEKHEAKKDPEHAHKHKIEEEIAAAAAVGAGGFAFHEHHEKKDAKKEEKKKLRGDTTISSKLLF

SEQ ID NO: 178 - protein, 426 aa, Glycine max
MLGPPRRGPAYKTKLCALWQRGNCNRDTCSFAHGHGDIRRPPSSRGAFTHHPGRRDYRAGDFRGRIDRRFSPRRRHSPGRESRGHRPLYDRRPSSRERDSSYSRSPSRKSERRHEKKTDDGETNSSRSLSLSDNNDEKKKDKFSSGDEKEDHEKQLKQIRLDMEALRDDKTQMEVILDEKIDEVRKISSKVNDLEVQLRREKDECHRMTSKMKKFIKAHARFLKAQEEVKRSQARFERLGDLLASDILKRGANEEGSSVNEDLNERSPNTAATKKRSIPYSTSEEAKAVKKRRERDSDTMTRSDKYRSDVTDFDKTSKGTEATKSLYLKKKLWEDEKSKLGANIFTEKVKGSPVRHVLPSTGMAAHAIDDLNEAIELEDRHESIDALLENDADDKTRSPAIPLQPPPVVQNAYEQYEGDDEEVDVE

SEQ ID NO: 179 - protein, 229 aa, Ovis aries
MSSLRNAIQRRAHKERAQPESRKKFGLLEKHKDYIVRAKAFHQKEETIRKLKEKASFRNPDEFYFKMINSKTVDGIHRPKPEANKYTEDELMLLKTKDMGYILQGIQSEKKKIEKLSSMLHELDNKRPNKHVYFAEDREEVKEIQSRIEQKSSSLGLDNIPSRIKRKTASSYRELEERKQRVQKLEKLYADMALQKELKKPGRKRKLREDEIENQTSRPVYKWRAQRKR

SEQ ID NO: 180 - protein, 66 aa, Zea mays
MAKGKDVRVKVILECTGCVRKSVNKGSRGVSRYITQKNRHNTPSRLELRKFCPYCYKHTIHGEIKK

SEQ ID NO: 181 - protein, 342 aa, Triticum aestivum
MQPPPMRERQRWRPEEDAILLAYVRQYGPREWSLVSQRMNRPLHRDAKSCLERWKNYLRPGIKKGSLTDDEQRLVIRLQAKHGNKWKKIAAEVPGRTAKRLGKWWEVFKEKQQRELRDRDRRRLPPPLDGDERGCAGGRYDWLLEDFADKLVNDHHRRMMAAPILPPWMSSSPSSSSSPSVTLSLASAAVAPAPAAPPPTWGGGGGGEVVVAELMECCREMEEGQRAWAAHRKEAAWRMKRVEMQLETERACRRREATEEFEAKMRALREEQAAAVERVEAEYREKMAGLRRDAEAKEQKMAEQWAAKHARLAKFLDQVAACRRWPPVEINGGGGGGPGGGR

SEQ ID NO: 182 - protein, 30 aa, Sus scrofa
APLEDEDDLELLEKVKRDRKKRLERQGAIN

SEQ ID NO: 183 - protein, 379 aa, Sus scrofa
MGIKGLTKLLADNAPKAMKEQKFESYFGRKIAVDASMSIYQFLIVVGRTGMETLTNEAGEVTSHLQGMFNRTIRLLEAGIKPVYVFDGKPPDMKKQELAKRYSKRDDATKDLTEAVEVGDKDAIEKLSKRTVKVTRQHNEDCKRLLRLMGVPVVEAPSEAEAECAALCINDKVFAVASEDMDSLTFGAPRFLRHLMDPSSKKIPVMEFDVAKVLEELELTMDQFIDLCILCGCDYCDSIKGIGGQTALKLIRQHGSIESILENLNKDRYQIPEDWPYQEARRLFKEPNVTLDIPELKWTAPDEEGLISFLVKDNGFNEDRVTKAIEKIKSAKNKSSQGRLESFFKPTATTSAPLKRKETSDKTSKAAANKKTKAGGKKK

SEQ ID NO: 184 - protein, 123 aa, Oryza sativa
MAKIKARDLRGKKKEELLKQLEDLKVELSQLRVAKVTGGAASKLSKIRVVRKSIARVLTVINQTQKENLRKFYKGKKYKPLDLRPKKTRAMRRRLNKHEENLKTKKQQRKERLYPLRKFAVKA

SEQ ID NO: 185 - protein, 150 aa, Oryza sativa
MAPKAEKKPAEKKPAEEKAGEKAPAAGKKPKAEKRLPASKGEKGGEGKKERGRKKAKKSVETYKIYIFKVLKQVHPDIGISSKAMSIMNSFINDIFEKLAGEAAKLARYNKKPTITSREIQTSVRLVLPGELAKHAVSEGTKAVTKFTSS

SEQ ID NO: 186 - protein, 93 aa, Sus scrofa
MASGQQERSQLDRKAREGETVVPGGTGGKSLEAHENLAEGRSRGGQTRREQMGEEGYSEMGRKGGLSTNDESGGERAAREGIDIDESKFKTKS

SEQ ID NO: 187 - protein, 135 aa, Oryza sativa
MVKFLKPNKAVILLQGRYAGKKAVIVKTFDDGTREKPYGHCLVAGIKKFPSKVIKKDSAKKTAKKSRVKAFVKLVNYQHLMPTRYTLDVDLKDAVVPDVLQSKDKKVTALKETKKSLEERFKTGKNRWFFTKLRF

SEQ ID NO: 188 - protein, 85 aa, Triticum aestivum
MLKLRLKRCGRKQQAVYRIVAIDVRSRREGRDLRKVGFYDPIKNQTCLNVPAILYFLEKGAQPTRTVYDILRKAEFFKEKESTLS

SEQ ID NO: 189 - protein, 1533 aa, Oryza sativa
MEVSPLQPVNENMQVNKTKKNEEAKKRLSIERIYQKKTQLEHILLRPDTYIGSVESVTQQMWVYDEDIGINYREVTFVPGLYKIFDEILVNAADNKQRDPKMSCIRVTIDPENNLISIWNNGKGIPVVEHKVEKMYVPALIFGQLLTSSNYDDEEKKVTGGRNGYGAKLCNIFSTKFTVETASREYKKMFKQTWMDNMGRAGEMELKPFNGEDYTCITFHPDLSKFKMQSLDKDIVALMVRRAYDIAGSTKDVKVFLNGNKLPVKGFRSYVDLYLKDKVDETGNPLKIIHEQVNHRWEVCLTMSEKGFQQISFVNSIATSKGGRHVDYVADQIVAKLVDVVKKKNKGGVAVKAHQVKNHMWIFVNALIENPTFDSQTKENMTLQVKSFGSTCQLSEKFIKAAIGCGIVESILNWVKFKAQVQLNKKCSAVKHNRIKGIPKLDDANDAGGRNSTECTLILTEGDSAKTLAVSGLGVVGRDKYGVFPLRGKILNVREASHKQIMENAEINNIIKIVGLQYKKNYEDEDSLKTLRYGKIMIMTDQDQDGSHIKGLLINFIHHNWPSLLRHRFLEEFITPIVKVSKNKQEMAFYSLPEFEEWKSSTPNHKKWKVKYYKGLGTSTSKEAKEYFADMKRHRIQFKYSGPEDDAAISLAFSKKQIDDRKEWLTHFMEDRRQRKLLGLPEDYLYGQTTTYLTYNDFINKELILFSNSDNERSIPSMVDGLKPGQRKVLFTCFKRNDKREVKVAQLAGSVAEMSSYHHGEMSLMMTIINLAQNFVGSNNLNLLQPIGQFGTRLHGGKDSASPRYIFTMLSPLARLLFPPKDDHTLKFLYDDNQRVEPEWYIPIIPMVLINGAEGIGTGWSCKIPNFDVREVVNNIRLLMDGEEPLPMLPSYKNFKGTIEELAPNQYVISGEVAILNSTTIEISELPIRTWTQTYKEQVLEPMLNGTEKTPPLITDYREYHTDTTVKFVVKMTEEKLAEAERVGLHKVFKLQTSLTCNSMVLFDHVGCLKKYDTVLDILRDFFELRLKYYGLRKEWLLGMLGAESAKLNNQARFILEKIDGKIIIENKPKKELIKVLIQRGYDSDPVKAWKEAQQKVPDEEENEESDNEKEADKSDSVADSGPTFNYLLDMPLWYLTKEKKDELCKLRNEKEQELETLKRKSPSDLWKEDLAAFIEELEAVEAKEKQDEQIGLPGKGGKAKGKKTQMAEVLPSPCGKRVIPRVTVEMKAEAEKKIKKKIKSENTEGSPQEDGMEVEGLKQRLEKKQKREPGTKTKKQTTLPFKPIKKAKKRNPWSDSESDISSDESNFNVPPREKEPRRAAAKTKFTVDLDSDEDFSDADEKTRDEDFVPSDTSPQKAETSPKHTNKEPKPQKSTPSVSDFDADDAKDNVPPSPSSPVADFPAVTETIKPVSKKNVTVKKTAAKSQSSTSTTGAKKRAAPKGAKKDPDLDSDVSKKPNPPKPKGRRKRKPSTSDDSDSNFEKMISKAVTSKKPKGESDDFHLDLDLAVASRAKSGRTKKPIKYLEESDEDDLF

SEQ ID NO: 190 - protein, 24 aa, Solanum lycopersicum
FENKVPEKQKLFQEDNGIPVHLKG

SEQ ID NO: 191 - protein, 209 aa, Solanum lycopersicum
MGRGKIEIKRIENSTNRQVTFSKRRSGILKKAREISVLCDAEVGVVIFSSAGKLYDYCSPKTSLSRILEKYQTNSGKILWDEKHKSLSAEIDRIKKENDNMQIELRHLKGEDLNSLQPKELIMIEEALDNGIVNVNDKLMDHWERHVRTDKMLEDENKLLAFKLHQQDIALSGSMRDLELGYHPDRDFAAQMPITFRVQPSHPNLQENN

SEQ ID NO: 192 - protein, 274 aa, Oryza sativa
MERGEGRRGDCSVQVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKNMEVCESEGIVLHKEVNISYDYFNVHEVVEMIIVELSADQKTEVHEEYQEGDDGFSLFSY

SEQ ID NO: 193 - protein, 137 aa, Zea mays
  MOD_RES (12)..(12): Any amino acid
  MOD_RES (41)..(41): Any amino acid
DPKDRKKIQFSXPAPPSQLDPRQLEMIRRRRPTPAMLFRLXEHSSPEEEASPHQRAAGEGHHLKSKRPNPCAYTPPSLKAVQRIAESHLQSISNLGENQASEEEDELGELRELGYPREEEEEEEEDDEEEEEEEDSQ

SEQ ID NO: 194 - protein, 75 aa, Spinacia oleracea
RKRGSQTYTRYQTLELEKEFHFNRYLTRRRRVEIAHVLCLTERQIKIWFQNRRMKWKKDHKDESSSSNLSANSEN

SEQ ID NO: 195 - protein, 274 aa, Sus scrofa
MERGEGRRGDCSVQVRKKRTRRKSDGPDSIAETIKWWKEQNQKLQEENSSRKAPAKGSKKGCMAGKGGPENSNCAYRGVRQRTWGKWVAEIREPNRGRRLWLGSFPTALEAAHAYDEAARAMYGPTARVNFADNSTDANSGCTSAPSLMMSNGPATIPSDEKDELESPPFIVANGPAVLYQPDKKDVLERVVPEVQDVKTEGSNGLKRVCQERKTMEVCESEGIVLHKEVNISYDYFNVHEVVEMIIVELSADQKTEVHEEYQEGDDGFSLFSY

SEQ ID NO: 196 - protein, 693 aa, Solanum tuberosum
MAAGSHGGYRGYEVAREREHDVGVSRRSKEHYHHRHPSRHRDSERRRDGGRSGGRELSNGYSHRRDSPRPPPRRRPSEGRTEDREPGEVSGGSGSERSGERPMKTGEPRENGVTRVSKEEAKMSPSKKRKQSPVIWDRNGSKRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEEAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQRMKEQGNNGDRGLFG

SEQ ID NO: 197 - protein, 380 aa, Oryza sativa
MGIKGLTKLLADNAPKAMKEQKFESYFGRRIAVDASMSIYQFLIVVGRTGMETLTNEAGEVTSHLQGMFNRTIRLLEAGIKPVYVFDGKPPDLKKQELAKRYSKREDATKELTEAVEEGDKDAIEKFSKRTVKVTKQHNEECKRLLRLMGVPVVEAPCEAEAECAALCINDMVYAVASEDMDSLTFGAPRFLRHLMDPSSKKIPVMEFEVAKVLEELELTMDQFIDLCILSGCDYCDSIKGIGGQTALKLIRQHGSIESILENINKDRYQIPEDWPYQEARRLFKEPNVTLDIPELKWNAPDEEGLVEFLVKENGFNQDRVTKAIEKIKFAKNKSSQGRLESFFKPVVSTSVPLKRKDTSEKPTKAVANKKTKGAGGKKK

SEQ ID NO: 198 - protein, 17 aa, Oryza sativa
AEVQDKGEFLAEGGGVR

SEQ ID NO: 199 - protein, 20 aa, Oryza sativa
GYLDYDEVDDNRAKLPLDAR

SEQ ID NO: 200 - protein, 721 aa, Oryza sativa
MPRRKKKGKEASGAQNLEKKDAETASSVSVKKKRRIEDGFIVISDSDGEEPKEENGLQKTKIKQSSRAKCLAKRKIAQMTEEEQFALALKMSEQEAREVNSQEEEEEELLRKAIAESLNSCRPSDASATRSRPLATGPSSESHQEKSTDSGTTEGIWQLVPPSLFKGSHISQGNESEEREEPWDHNENTEEEPVSVSSGSWDQSSQPVFENENVKCFDRCTGHLAEHTQCGKPQNECGRGSAFLKAVQGSGDTSRHCLPTLADAKGLQDTGGTVNYFWGIPFCPDGVDPNQYTKVILCQLEVYQKSLKMAQRQLLNKKGFGEPVLPRPPSLIQNECGQGEQASEKNEGISEDMGDEDKEERQESRASVWRAKTKDFQEGPIKTLKEKLLLEEEPTTSHGQSSQGLFVEETSEEGNSVPASQSIAALTGKRSSVLMPESSAEEITVCPETQLSSPETFDLEKEGFPDSRETLYEVSIMADKEVDNREDAKKEIHTSTFSSSTQVSCPLCDQGFPPTKIERHAMYCNGLMGGDTVLTRRQKEAKNKSDNGIAAQTSLDIDKNEKCYLCKSLVPFREYQCHVESCLQLARVDQGDGPEESGRLCLAVDGKRPQQLKNLKEKDRSEGRLISLLEQSEYKTTDAEIKTKFSETGDFRVPSAGVEEAGCSREMQSSLAHLDLNESPIKSFVSVSEAADCLVDFKKQLTARPGSRTRTKAGRGRRRKS

SEQ ID NO: 201 - protein, 265 aa, Oryza sativa
MKAVVLTLAVLFLTGSQARHFWQQDDPQSPWDRVKDFATVYVDAIKDSGRDYVAQFEASALGKHLNLKLLDNWDSLGSTFTKVREQLGPVTQEFWDNLEKETEALRQEMSKDLEEVKKKVQPYLDDFQNKWQEEMETYRQKMAPLGAEFREGARQKVQELQEKLSPLAEELRDRLRAHVEALRQHVAPYSDDLRQRMAARFEALKEGGGSLAEYQAKAQEQLKALGEKAKPALEDLRQGLLPVLENLKVSILAAIDEASKKLNAQ

SEQ ID NO: 202 - protein, 609 aa, Solanum tuberosum
MASAGDRRGGGGPPGSGDDSGGGWETVEKRVKKPAQQVGKGQWGQWNSPNAAPAPTAPWSGSGAFHHSGNTLVRHSDRRPARGTPRPPPQNRSTGAELQAPRGVVTAPLANGWQWGARSCPPGTESKEGGLPLSGCDPETDNAEGDDTSDDDNDDDMSDDLSDDYDSDASEKSFETRKNHKLFKGFFEVLDALSVEQLNEPTRQWHCPACKNGPGAIDWYKGLQPLMTHAKTKGSIKVKRHRELASLLEEELSRRGTSVVPSGEQFRKWKGLREGTDREIVWPPMVVVMNTVLEQDEDDKWKGMGNQELIDYFSEYAASKARHAYGPNGHRGMSVLIFDSSAVGYMEAERLHDHFVRQRTDRNTWNSAHKVTFLPGGKRQLYGFLATKDDMETFNRHCHGKSRLKYEMRSYNEMVVTQMKQMSEDNQQLNYLKNKMVKKEQHSKLVEDTLSVVTQKLRETMEENTIVRNKAKEKHLEYEKEMKYQEEFFHDQIEKIHKPTEEKEIKFEKLLQEERAKARQSDVDSGSTEDRRQRKEKIQNFIDCQVKDVEEFEAERDKLIKLHEEKKVKLKKEYLAKEFELEKELDTALTALMDKHKPDIFKSSTSPST

SEQ ID NO: 203 - protein, 103 aa, Sus scrofa
MAKKSLIQRERKRQKLEQKYHLIRRSSKKKIRSKVYPLSLSEKTKMREKLQSLPRNSAPTRLHRRCFLTGRPRANYRDFGLSGHILREMVYACLLPGATRSSW

SEQ ID NO: 204 - protein, 196 aa, Oryza sativa
MGRGRSEIKRIENPTQRQSTFYKRRDGLFKKARELAVLCDADLLLLLFSASGKLYHFLSPTVPSVREFVERYEATTHTKVWADIRQERRAELEKVGSMCDLLEKQLRFMTVDDGEEYTVPSLEALEHNLEAAMRKVRSEKDRKIGGEICYLQNIIRGRQEERYGLCDKIAHAQTLKDVECGSTSLSNGLDLKLGFN

SEQ ID NO: 205 - protein, 261 aa, Oryza sativa
MTASKDRENFVYIAKLAEQAERYEEMVESMKNVANLDVELTVEERNLLSVGYKNVIGARRASWRILSSIEQKEETKGNELNAKRIKEYRQKVELELSNICNDVMRVIDEHLIPSAAAGESTVFYYKMKGDYYRYLAEFKSGNEKKEAADQSMKAYESATAAAEADLPPTHPIRLGLALNFSVFYYEILNSPERACHLAKQAFDEAISELDTLNEESYKDSTLIMQLLRDNLTLWTSDIPEDGEDAQKVNGTAKLGGGEDAE

SEQ ID NO: 206 - protein, 101 aa, Oryza sativa
MSDQEAKPSTEDLGDKKEGEYIKLKVIGQDSSEIHFKVKMTTHLKKLKESYCQRQGVPMNSLRFLFEGQRIADNHTPKELGMEEEDVIEVYQEQTGGHSTV

SEQ ID NO: 207 - protein, 245 aa, Zea mays
MDKNELVQKAKLAEQAERYDDMAACMKSVTEQGAELSNEERNLLSVAYKNVVGARRSSWRVVSSIEQKTEGAEKKQQMAREYREKIETELRDICNDVLSLLEKFLIPNRSQPESKVFYLKMKGDYYRYLAEVAAGDDKKGIVDQSQQAYQEAFEISKKEMQPTHPIRLGLALNFSVFYYEILNSPEKACSLAKTAFDEAIAELDTLSEESYKDSTLIMQLLRDNLTLWTSDTQGDEAEAGEGGEN

SEQ ID NO: 208 - protein, 95 aa, Spinacia oleracea
MASGQQQQGRSELDRMAREGQTVVPGGTGGKSLEAQENLAEGRSRGGQTRKEQMGEEGYREMGRKGGLSTGDESGGERAAREGIDIDESKYKTKS

SEQ ID NO: 209 - protein, 145 aa, Glycine max
MAPKAAAGKKPAEKKPVEEKKAEEVPAEKKPKAGKKLPKDAGRPDKKKKRAKKSIETYKIYIFKVLKQVHPDIGISSKSMGIMNSFINDIFEKLAQESSRLARYNKKPTITSREIQTAVRLVLPGELAKHAVSEGTKAVTKFTSS

SEQ ID NO: 210 - protein, 582 aa, Triticum aestivum
KEDLVKQHAKVAEEAIAGWEKAENEVAVLKQQLDAAVQQNLTLEVRVSHLDGALKECVRQLRQARDEQEKMIQDAMAEKNEMESEKTALEKQLLKLQTQVEAGKAEMPTSTDPDILVRLKYLEKENAALKIELVSCSEVLEIRTIERDLSTQAAETASKQQLESIKKLTKLEVECRKLQAMARKSSPFNDQRSSAVSSFYVDSVTDSQSDSGERLNTVDNDALKMSKLETREYEPSCSNSWASALIAELDQFKNEKAMPKTLAACSIEIDMMDDFLEMEQLAALSETANKTPSVTSDAVPHDSPNIENPLAAEYNSISQRVVELEQKLEKIEAEKAELENAFNESQDALKVSSLQLKETQTRLEGLQKELDVVNESKELLEFQLYGMEVEARTMSVNIDSLKTEVEKEKSLSSEMEAKCHELENDLRKKSQEAEAQQTSGSNSELKIKQEDLAVAADKLAECQKTIASLGKQLQSLATLEDFLTDTANLPGGGAVVAKAGGELWKLHVNETFTPKRDSDPTKVEENVSHSTNENEGESPASSSSSSTSSTTQASTGKSKNGFGKLFSRSKSGVPTLKVIEDK

SEQ ID NO: 211 - protein, 567 aa, Oryza sativa
MGRSRGVPNSGDDETNHRSKRRRVASSGDAPDSLSAACGGAGEGGGKKALYHCNYCNKDISGKIRIKCSKCPDFDLCVECFSVGAEVTPHRSNHPYRVMDNLSFPLICPDWNADEEILLLEGIEMYGLGNWAEVAEHVGTKTKAQCIDHYTTAYMNSPCYPLPDMSHVNGKNRKELLAMAKVQGESKKVLPGDLTPKDESPFSPPRVKVEDALGEGLAGRSPSHIAGGANKKASNVGQFKDGANVAKVEDGHVDRSIGVKKPRYSADEGPSLTELSGYNSKRHEFDPEYDNDAEQALAEMEFKETDSETDRELKLRVLRIYLSRLDERKRRKEFILERNLLFPNPLEKDLTNEDKEVYHRYKVFMRFLSKEEHEALVRSVLEERKIRRRIQELQECRSAGCRTLAEAKIHIEQKRKKEHEVNAQKAKESGQLLSNTKVVHKTNRPMKIESDGNLDQKKGGASLDSTGRDSPKTTGHAGTKHWDDWDIVGFPGAELLSTSEKNLCCQNRLLPNHYLKMQEVLMQEIFKGSVAKKEDAHVLFKVDPAKVDNVYDMVTKKLGTNEEAPTV

SEQ ID NO: 212 - protein, 138 aa, Oryza sativa
MDTERSSEICGNVPDVTLSTPKGKVFSTPKGAHKRTPYSGHTKVNSSFKSPVQTSSTSPAKPEEEIEELKKRRAKLDSEIALLEKDGIRVDELEQHIDLLHEYNDIKDIGQSLVGRIAALRGVTTRDLYGQFGLELDD

SEQ ID NO: 213 - protein, 304 aa, Sus scrofa
MGGFVKTQKTNAYYKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 214 - protein, 239 aa, Pisum sativum
MGQKINPLGFRLGTTQKHHSFWFAQPKNYSEGLQEDKKIRDCIKNYIQKNRKKGSNRKIESDSSSEVITHNRKMDSGSSSEVITHIEIQKEIDTIHVIIHIGFPNLLKKKGAIEELEKDLQKEINSVNQRFNISIEKVKEPYRQPNILAEYIAFQLKNRVSFRKAMKKAIELTKKADIRGVKVKIAGRLGGKEIARAESIKKGRLPLQTIRAKIDYCCYPIRTIYGVLGVKIWIFVDEE

SEQ ID NO: 215 - protein, 719 aa, Glycine max
MEEVRRHHHFIKVMVGEFARRLEIPQGFLIHIPEVDHSTFDASLPSSAKGTLQNSEGKTWPVELEKLDGHVFLTTGWAKFVEDNSLREYEFLLFRYDDNMHFMVLPFGLNACEKVIRSSGSPQGKLPCDIFCCTKRGRDGDRLTEAANSLTPSHSQVLQRTTQGHELISPQSFPDQHEVCGSKDGLDEHLSLNGPMEDDKANAIAEVMSILDVDKVTVELFCAMLVFYKWNVDAVAEDFDICRGKPQIQNLFLKHKLHFQFDIVKRKLRKFFPPDDYYSSPILESRKCSLEEPKLSNQPLQCDLTTEKCRLVDEHDLCNFSQKKRRKRGSFCSPETPRRSPRLARQNNSHDSAENTLKERSEERQPSPDSMIDQAESRSEQACLCHDKTDSGSLFQDSKKVKPAHGEVDLCEEPQHNQGENEGNLDQVNNKETDEEQIERNAVETSESFTRRGCIKSSPASCEVPACLRINELSLTWKPAEHVNPLEKVLLDIQRDNFMKTISHVQGIIRNHPSDLLTADVITVVVQKEIFKWNCCLKDRDAQRIVNALLEHARKIKEMHNFNSEMRKEEFSAKLKVHLKWQLKEVETIYTSLELDYKKATSDDNIAFSMLHDKKKKLHNLQDEITGLQQSLEMKKDEMQKLAHQVAEHESVFQKSLMERLRIKEVMKGYEQTLAEVKVQLTSTEVGSIDIEALVKVEMDNMTKEIELSKESLLNITFH

SEQ ID NO: 216 - protein, 85 aa, Sus scrofa
ELKEMLLKKYSGCLSRLRSEFLKKRKKGKLPKDARSALMDWWNTHYRWPYPTEEDKVRLAAMTGLDPKQINNWFINQRKRHWKPS

SEQ ID NO: 217 - protein, 103 aa, Sus scrofa
MAKKSLIQREKKRQKLEQKYHLIRQSLKKKIRSKVSPLSLSEKTKMREKLQSLPRNSAPTRLHRRCFLTGRPRANYRHFGLSGHVLREMVYECLLPGATRSSW

SEQ ID NO: 218 - protein, 269 aa, Oryza sativa
MRSPAALLPVVADGGGGVGVEEEMDVDEDMAMCGGRGGGGGEKKRRLSVEQVRALERSFETENKLEPERKARLARDLGLQPRQVAVWFQNRRARWKTKQLERDYAALRQSYDALRADHDALRRDKDALLAEIKELKGKLGDEDAAASFSSVKEEEDPAASDADPPATGAPQGSSESDSSAVLNDAEILPHKPAPAAAADAAASEETEAVVTGAALLHHAEVFFHGQLLKVDDDEAAFLGDDGAACGGFFADEHLPSLPWWAEPTEQWTT

SEQ ID NO: 219 - protein, 155 aa, Oryza sativa
MQIFVKTLTGKTITLEVESSDTIDNVKAKIQDKEGIPPDQQRLIFAGKQLEDGRTLADYNIQKESTLHLVLRLRGGAKKRKKKTYTKPKKQKHKHKKVKLAVLQFYKVDDATGKVTRLRKECPNAECGAGTFMANHFDRHYCGKCGLTYVYNQQA

SEQ ID NO: 220 - protein, 258 aa, Oryza sativa
MAPKRGGRAPVPAKKKTEKVTNPLFEKRPKQFGIGGALPPKKDLHRFVKWPKVVRIQRQRRILKQRLKVPPALNQFTRTLDKNLATNLFKMLLKYRPEDKAAKKERLLKRAQAEAEGKTVEAKKPIVVKYGLNHVTYLIEQSKAQLVVIAHDVDPIELVVWLPALCRKMEVPYCIVKGKARLGSIVHKKTASVLCLTTVKNEDKLEFSKILEAIKANFNDKFDEVRKKWGGGVMGSKSQAKTKAREKLLAKEAAQRMT

SEQ ID NO: 221 - protein, 633 aa, Pisum sativum
MSFSKWGGKPSNSSEKQKASSTPTVEEINRGVGDIGLNSEQNEGWEVYARKPKNKGGSSAGKQWAPQNPSPKAWGNQNTKAWGHPDVGKKSGTRNNAGSGRGSGNNWSTPSDPQKLARPHLYDGGFPSSAPVPPALKNGWDWSSRVASAHPKDNSQVAAAADDDKASEHDAEDNELDFLDESDDDLHSDDFDSDVGEMSYETRKKNPWFNQLFHSLDSLTVTEINEPERQWHCPACKGGPGAIEWFTGLQSLMTHAKTKGLRVKIHRELAELLEEDLRQRGTSVVPPGEVYGRWGGMEFKDKEIVWPPMVIIMNTRLDKDENDKWIGMGNQELLEYFSSYAAVKARHSYGPQGHRGMSLLIFEASAVGYIEADRLSEHFSENGRNRDAWERRSARFYPGGKRLLYGYMADKKDIDNFNQHSAGKSKLKFEMRSYKEAVWNPAKQMREDNQQLIWFKNKAAKHQMQAKALEESLSLVSEKHRQTLEENKIVRLKTKMHHEQIKEEMEFQEQFFKDQIKIIHDARTAREDNFEKTQQEQREMVKQSNANTASVEDHRVRAEKVAKFIKLQDKEMEEFVEERENLMRTHDDRIAALRRKYWEEEVELERKFDLELSKLMEKYSPKQSDEVNSSGTM

SEQ ID NO: 222 - protein, 101 aa, Capra hircus
MDKSKRPFLKFKRSFRRRLPPIQSGDRIDYRNMSLISRFISEQGKILSRRVNRLTLKQQRLITLAIKQARILSLLPFLNNEKQFERTESTARTTGFKARNK

SEQ ID NO: 223 - protein, 1048 aa, Oryza sativa
MDGAVRGQGCVGRLRSFNKTKKKNRNCSDDMRNGDDEEKKYSHHDMKNNLRNDANEEKRKSSDDMRDGDFEEKKKCSRHDMKKNLRNDANEEKRKSSDDMRDGDDEEKKCSRQDMKKNLRNDADEEKRKSSDDMRDGDDEEKKKRSRHDMKKNSRNDADEEKRKRKRKCSDDLKKSVVNDASKEATSHSDWRKNRKAGSDAEQRGKKLLNGDKKAKSRKVTTPFFEKMRKIKMQRTSNQNGEKNMKSDGDSYKKTVPLSVNKGKMEKDGTNKRTLSNTLVAKERKMRPSDSMEMKMKKKKRDASFVQPDERTAQTFSTKNKEKKRKAPSTPLKREQKERVASSDNKKETKKACIVAIGNEKKNCRDGKKKKRKAAFAFFKFVRDEFEELLFIPPAVAPSLKDLIDRHVYLEDSEGKCSKIRLSVVDGSLAFYEGWNSFVSEHCIKWGEFLLFEYTPESTFSVRVFGIDSCERLHFSVKSGGKGAVKKRKERHTLSDDLISHYNGQYQDSEDIHDGPNVSGESPRSKEPKITVDAEIGTRNLVAKSINAASETQDSERVESGIGYGSLGALGNKVRNLSNGECDTRSDSVFCIQEKTRRSEVIIISDEAYSTQVDEDTMKQTAPSEASEIHHVTINTQKDLERVVDGVCCESSVALNNKMGNLILGEPKNKNISPACSTEKTNGSEITPTTGVIPLTQENIDTVKLNTLSCFEEDRSTTRESELAAAIPTTSETHDSDKDLGQKHQRNSVQVNSIIAVDKYPNDSEMNISGNIFRIYEAPAGTRCLEKWKRGIVNGRAALDDIGQVRPEKTQKAGEKLVGNCGAMGESPVDLRIESDVTDTCLKPILNIPIEELSILDSVSISKCGRSRTEVNHLFNQKGATVQLQTKKEPLKPTGSSGNRKGDKIAVSVNRVFAHQSELQIPQQENGNFTSCVTPVALLPAKAELLDLDDHSLQFCIPSTIQKWLELPKSLPITCRQKGRYDRNVVILKDPMRRLWPVFYHDKPVFVGFTAGWKPFAAANNLQAGDVCKFVKEMDEDELAFQVYITRK

SEQ ID NO: 224 - protein, 575 aa, Oryza sativa
MSELLFETYGVPSIGNDTYLFVPLLSIVHGSFEVRIVDAKDVSSYFLKGEPVLGACCRTNVGGFHITDFLRQLLSLKYPYHSASITWEKAEELKKEHCYVALDYMSELQIFKNNKEEAEEKTRYWQLPWVPPPVEEPPSEEELARKAALKEKAGQRLRDMAAAKRSQKIAELEKQLSYLEELMEQLDGAEEEEATAILGRSGYLSQQEIKSAILKATQSLRKAKGESNGNEEKADASGVDKYPLVSVPDETLTPEQLKEKKKQILLKTTTEGRMRAKQRRAEEEALREKQEEERRLENPELYLEELRARYSELSDRVDQRKRQKLNGGKTNGNHNSSGGVGRGERLNAAQKERMRLLTSAAFDRGKGEDTFGTRDEDWLVYKKMSKDNDDDDDGNDDDESELARIASKIQDMDPTFVNKAEAVQQTPEPPKVRTLTAEDYRISIGIERFRCPEILFQPGMIGIDQAGIDEMVSISLRRLMEDEAVKERLCQSILVTGGCSLIPGMIPRLESGIRQFRPYLSPLKLVRAADPLIDAWRGAAAFAASSKFGRHTFSLADYREHGENLFHRYNIVYSL

SEQ ID NO: 225 - protein, 594 aa, Solanum tuberosum
MSGSGDRRGGGPPGSHSGWETMGKKSKKPGQAGGRQWAPWSSTNVTPNTARPAWGGSGSSHPSGTSWAQAPDHGAATRGNPRPPSQTSRPVLAPPLANGWQWQSRPRPSGSEVKKDDAPPSGSVPEVENVDGNNTSDDDDDDDDDLSDDISDDYDSDASEKSFETRKTNKWFKEFFEVLNTLSLEQINEQTRQWHCPACKNGPGAIDWYKGLQPLVSHARTKGSTRVKLHRELAALLEEELSRRGTSVLPAGEQFGKWKGLQESTDREIVWPPMVIVMNTFLEKDEDDKWKGMGNQELLDYFGEYEASKARHAYGPSGHRGMSVLIFESSAVGYMEAERLHKHFVNQGTDRNSWHLRKVRFVPGGKRQLYGFLANKEDMEAFNKHCHGKSRLKYEMRSYNEMVVIQMKQMSEDNQQLNYLKNKMVKTEQRSKAVEESLGVVTQKLRETIEENIFVRSKAKEKHMEYEEEMKSQEEIFHGLIEDIHKATEDKEKQFEKLLQEERSKARRFDVDSGTMKDRQLRKEYVQKFIDCQVKDVAEFEVERDELIKVHEDKKLKLKKEYMDLELELEKEFDAALTGLMEKHKPDTFEASSS

SEQ ID NO: 226 - protein, 154 aa, Oryza sativa
MAPKAEKKPAAKKVAEEEPSEKAAPAEKAPAGKKPKAEKRLPAGKSAGKEGGDKKGRKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 227 - protein, 199 aa, Oryza sativa; identical to SEQ ID NO: 144

SEQ ID NO: 228 - protein, 427 aa, Solanum lycopersicum
MIYTAIDTFYLTDEQLRDSPSRKDGIDEATETALRVYGCDLIQESGILLKLPQAVMATAQVLFHRFYCKKSFVRFSVKRVAASCVWLAGKLEESPRRSKHIIIVFHRMECRRENVPIEHLDVFSKKYSDLKHDLVRTERHLLKEMGFICHVEHPHKFISNYLATLEAPELTQEAWNLANDSLRTTLCVRFKSEVVACGVVYAAARRHGVPLPEDPPWWNVFDADEAGIQEVCRVLAHLYSLPKSQYIQVYKDNDSFTHRRTSDTNASKESPATTVASDKGTPVPSSSSQEKDALIKAGSDKVKEKGDDDGKTLPSEPNGKEGPAVNLKSEKSESNVDRSRERERDRSRGRDRDSRGRDSDRDSKGRDSDRERERDREADRDRQRRHHSKDRSSGYSDKEKSRHRSSRDRGDHYSSHSSRDKDRHRRQ

SEQ ID NO: 229 - protein, 110 aa, Oryza sativa
MTTKIRIVIRSFDHPFLENHFGGLPPYTWKIGLPESRVLYTVLRSPHIDKKSREQFEMEIKKKYLVIKTEKHELRKKFFWLKRQRLFGAQYEILFFCKTRSDKGKLQRLL

SEQ ID NO: 230 - protein, 128 aa, Oryza sativa; identical to SEQ ID NO: 154

SEQ ID NO: 231 - protein, 360 aa, Zea mays
MEKYEAVRDIGSGNFGVARLMRNRETRELVAVKCIERGHRIDENVYREIINHRSLRHPNIIRFKEVILTPTHLMIVMEFAAGGELFDRICDRGRFSEDEARYFFQQLICGVSYCHHMQICHRDLKLENVLLDGSPAPRLKICDFGYSKSSVLHSRPKSAVGTPAYIAPEVLSRREYDGKLADVWSCGVTLYVMLVGAYPFEDQDDPKNIRKTIQRIMSVQYKIPDYVHISAECKQLIARIFVNNPLRRITMKEIKSHPWFLKNLPRELTETAQAMYYRRDNSVPSFSDQTSEEIMKIVQEARTMPKSSRTGYWSDAGSDEEEKEEEERPEENEEEEEDEYDKRVKEVHASGELRMSSLRI

SEQ ID NO: 232 - protein, 154 aa, Oryza sativa
ISGMSGRKASGSSPTSPINANKVENEDAFLEEVAEEKPHVKPYFTKTILDMDVVEGSAARFDCKVEGYPDPEVMWFKDDNPVKESRHFQIDYDEEGNCSLTISEVCGDDDAKYTCKAVNSLGEATCTAELLVETMGKEGEGEGEGEEDEEEEEE

SEQ ID NO: 233 - protein, 139 aa, Zea mays
MAPKAEKKPAEKKPVEEKAEKKPKAEKRVPGAKEGGGEKKGKKKAKKSVETYKIYIFKVLKQVHPDIGISSKAMSIMNSFINDIFEKLAQEAARLARYNKKPTITSREIQTSVRLVLPGELAKHAVSEGTKAVTKFTSS

SEQ ID NO: 234 - protein, 358 aa, Triticum aestivum
MDPAAAGIVKEEMLESQQQQRQEDGGAAPRPMEGLHEVGPPPFLTKTYDLVEDPATDGVVSWSRAGNSFVVWDPHVFADLLLPRLFKHNNFSSFVRQLNTYGFRKVDPDRWEFANEGFLRGQRHLLKTIKRRKPPSNAPPSQQQSLTSCLEVGEFGFEEEIDRLKRDKNILITEVVKLRQEQQATKDHVKAMEDRLRAAEQKQVQMMGFLARAMRNPEFFQQLAQQKEKRKELEDAISKKRRRPIDNVPFYDPGETSQTEQLDSPYLFDSGVLNELSEPGIPELENLAVNIQDLGKGKVDEERQNQTNGQAELGDDFWAELLVEDFTGKEEQSELDGKIDGIDELAQQLGYLSSTSPK

SEQ ID NO: 235 - protein, 260 aa, Salmo salar
MADSSREENVYLAKLAEQAERYEEMIEFMEKVAKTADVEELTVEERNLLSVAYKNVIGARRASWRIISSIEQKEESRGNEDHVNTIKEYRSKIEADLSKICDGILSLLESNLIPSASTAESKVFHLKMKGDYHRYLAEFKTGTERKEAAENTLLAYKSAQDIALAELAPTHPIRLGLALNFSVFYYEILNSPDRACNLAKQAFDEAISELDTLGEESYKDSTLIMQLLRDNLTLWTSDNADDVGDDIKEASKPESGEGQQ

SEQ ID NO: 236 - protein, 384 aa, Oryza sativa
MGLLCSKSNRYNDAKAEENAQTAEIERRIELETKAEKHIRKLLLLGAGESGKSTIFKQIKLLFQTGFDEAELKSYLPVVHANVYQTIKLLHDGSKEFAQNDVDFSKYVISTENKDIGEKLSEIGGRLDYPRLTKELAQEIESIWKDAAIQETYARGNELQVPDCTHYFMENLQRLSDANYVPTKEDVLLARVRTTGVVEIQFSPVGENKKSGEVYRLFDVGGQRNERRKWIHLFEGVSAVIFCVAISEYDQTLFEDENKNRMMETKELFEWVLKQQCFEKTSFMLFLNKFDIFEKKILDVPLNVCEWFKDYQPVSTGKQEIEHAYEFVKKKFEESYFQSTAPDSVDRVFKIYRTTALDQKVVKKTFKLVDETLRRRNLFEAGLL

SEQ ID NO: 237 - protein, 179 aa, Oryza sativa
MAREGLGLEITELRLGLSCGEPKKNEKKRMFSEIDGGVEENGGSGDRKSVDKKNQVVGWPPVCSYRKKNMNEGSKMYMKVSMDGAPYLRKIDLCLHKGYLELALALEKLFDCCGIEEALKDAENCEHVPIYEDKDGDWMLVGDVPWEMFIESCKRLRIMKRSDAKGFDLQPKGSLKRFI

SEQ ID NO: 238 - protein, 101 aa, Capsicum annuum
MDKSKRPFIKSKRSFRRRLPPIQSGDRIDYRNMSLISRFISEQGKILSRRVNRLTLKQQRLITSAIKQARILSLLPFLNNEKQFERTESTTRTANFRTKNK

SEQ ID NO: 239 - protein, 19 aa, Zea mays
ADDSDPVGGEFLAEGGGVR

SEQ ID NO: 240 - protein, 304 aa, Zea mays
MGGFVKTQKTNAYHKRFQVKFKRRRQGKTDYRARIRLTNQDKNKYNTPKYRFVVRFTNKDITAQIVYATIAGDIVMAAAYSHELPRYGLEVGLTNYAAAYCTGLLLARRVLKLRGLDQEYEGNIEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMEALYKKVHAAIRADPTMAKSTKKEPATHKRYNLKKLTYEQRKASLVERLNALNSSAGADDDDEEEDDE

SEQ ID NO: 241 - protein, 384 aa, Oryza sativa
MGLVCSRNRRYRDSDPEENAQAAEIERRIESETKAEKHIQKLLLLGAGESGKSTIFKQIKLLFQTGFDEAELRSYTPVIFANVYQTIKVLHDGAKELAQNDLNSAKYVISDESKDIGEKLSEIGSRLDYPHLTKDLAKEIETLWEDAAIQETYARGNELQVPDCTKYFMENLQRLSDANYVPTKGDVLYARVRTTGVVEIQFSPVGENKRSGEVYRLFDVGGQRNERRKWIHLFEGVTAVIFCAAISEYDQTLFEDESKNRLMETKELFEWILKQPCFEKTSFMLFLNKFDIFEKKILNVPLNVCEWFKDYQPVSSGKQEIEHAYEFVKKKFEELYFQSSAPDRVDRVFKIYRTTALDQKVVKKTFKLVDETLRRRNLFEAGLL

SEQ ID NO: 242 - protein, 85 aa, Oryza sativa
MVKLRLKRCGRKQQAIYRIVAIDVRSRREGRDLRKVGFYDPIKNQTCLNVPAILYFLEKGAQPTRTVYDILRKAEFFKDKERTLS

SEQ ID NO: 243 - protein, 231 aa, Sus scrofa
MGSRLTQDEFHPFIEALLPHVRAFAYTWFNLQARKRKYFKKHEKRMSKDEERAVKDELLGEKAEVKQKWASRLLAKLRKDIRPECREDFVLAITGKKAPGCVLSNPDQKGKMRRIDCLRQADKVWRLDLVMVILFKGIPLESTDGERLVKAAQCGHPVLCVQPHHIGVAVKELDLYLAYFVRERGEAGRARGRGSDGREGMRRASQSGRPGESGPAGLRDQAGTRSLGWAG

SEQ ID NO: 244 - protein, 276 aa, Capra hircus
MDSACKPTQRRLDAAGFWQIWQRFDADEKGYIEEKELDAFFHHVLTKLGTDDAVMEENVWKMKQQFMAAHDVSKDGHIQMKELACLFLSEDENFLLLFRQETPLDSSVEFMQIWRKYDADSSGFISAAELCNFLRDLFLHHKKAISEAKLEEYTGTMMKIFDKNKDGRLDLNDLARILALQENFLLQFKMDACSTEERKRDFEKIFAHYDVSKTGALEGPEVDGFVKDMMELVQPSISGVDLDKFREILLRHCDVNKDGKIQKSELALCLGLKINP

SEQ ID NO: 245 - protein, 451 aa, Spinacia oleracea
MALQNIGASNRDDAFYRYKMPRMITKIEGRGNGIKTNVVNMVDIAKALARPASYTTKYFGCELGAQSKFDEKTGISLVNGAHDTAKLAGLLEVFIKKYVQCYGCGNPETEILISKTQMISLKCAACGFVSDVDMRDKLTTFILKNPPEQKKGGKDKKAMRRAEKERLKEGEAADEEQKKLKKDAKKKGSKDSTAKGLKKKATTATGSDEDHSSSPTRSHDGDKAAADDDDDDVQWQTDTSIEAAKQRMQEQLSAATAEMVMLSTEETEKKMKQPTHKDGSTNGSAKEIPNDKPAVTKPSPYEELIGDIKASLGSAPTPSQLKAVLASSTLPPQDVMNAPLEALFGGVGKGFTKEVVKNKKYLAVAVPDEGAQTLLVQAIEAFGGKCNPEALKEVPVVLKALYDGDILDEETIVDWYNDAVAAGKDSQVVKNAKPFVEWLQSAESDEEGDDE

SEQ ID NO: 246 - protein, 107 aa, Sus scrofa
MTEKKNRREKKNPREAKITFEGLVMEALPNGMFRVRLENDTIILGYISGKIRSSSIRILMGDRVKIEVSRYDSSKGRIIYRLPHKDSKRTEDSKDTEDLKDTKDSKG

SEQ ID NO: 247 - protein, 265 aa, Sus scrofa
MAREKIQIKKIDNSTARQVTFSKRRRGLFKKAEELSVLCDADVALIIFSSTGKLFDYSSSSMKQILERRDLHSKNLEKLDQPSLELQLVENSNYSRLSKEISEKSHRLRQMRGEELQGLNIEELQQLERSLETGLSRVIERKGDKIMREINQLQQKGMHLMEENEKLRQQVMEISNNNNNNNNGYREAGVVIFEPENGFNNNNNEDGQSSESVTNPCNSIDPPPQDDDSSDTSLKLGLATLLRLKRSKARCGYFCMLLEEGEKKK

SEQ ID NO: 248 - protein, 145 aa, Salmo salar
MPKIKTSRVKYPEGWELIEPTLRDLEAKMREAENDPHDGKRKCEALWPIFRISHQKSRYIYDLYYRRKEISKELYEFCLDQGHADKNLIAKWKKPGYERLCCLRCIQTRDHNFATTCVCRVPKHLREEKVIECVHCGCRGCASGD

SEQ ID NO: 249 - protein, 132 aa, Zea mays
MVVLQPDPFLSELTSMYERSTEKGSVWVTMKRSSMKCQARLKKMAAKGEAVEYRCLVRATDGKKNICTALSAKEYLKFQASYATVLKAHMHALKKRERKDKKKAAEVEKIPEKAPKKQKKAPSSKKSAGSKS

SEQ ID NO: 250 - protein, 128 aa, Oryza sativa
MTRVKRGYIARRRRKKIRFFASSFRGAHSRLTRTIAQQKIRALVSAHRDRDRQKRDFRRLWITRINAAIRERGVYYNYSKFIHDLYKRQLLLNRKILAQIAILNPNCIYMIYNEIIKKEDCKKYLEII

SEQ ID NO: 251 - protein, 150 aa, Zea mays; identical to SEQ ID NO: 185

SEQ ID NO: 252 - protein, 139 aa, Oryza sativa
MANSSSGLAVSDECKVKFRDLKARRSFRFIVFRIDDKDMEIKVDRLGEPNQGYGDFTDSLPADECRYAIYDLDFTTVENCQKSKIFFFSWSPDTARTRSKMLYASSKDRFRRELDGIQCEIQATDPSEMSLDIVKSRTN

SEQ ID NO: 253 - protein, 100 aa, Triticum aestivum
MSAAGEEDKKPAGGEGGGAHINLKVKGQDGNEVFFRIKRSTQLKKLMNAYCDRQSVDMNAIAFLFDGRRLRGEQTPDELEMEDGDEIDAMLHQTGGCLPA

SEQ ID NO: 254 - protein, 339 aa, Sus scrofa
MSTVHEILCKLSLEGDHSTPPSAYGSVKAYTNFDAERDALNIETAIKTKGVDEVTIVNILTNRSNEQRQDIAFAYQRRTKKELASALKSALSGHLETVILGLLKTPAQYDASELKASMKGLGTDEDSLIEIICSRTNQELQEINRVYKEMYKTDLEKDIVSDTSGDFRKLMVALAKGRRAEDGSVIDYELIDQDARDLYDAGVKRKGTDVPKWISIMTERSVCHLQKVFERYKSYSPYDMLESIKKEVKGDLENAFLNLVQCIQNKPLYFADRLYDSMKGKGTRDKVLIRIMVSRSEVDMLKIRSEFKKKYGKSLYYYIQQDTKGDYQKALLYLCGGDD

SEQ ID NO: 255 - protein, 153 aa, Pisum sativum
MAPKADKKPAAKKPAEEEPATEKAEKAPAGKKPKAEKRLPAGKSAGKEGGEGKKGKKKAKKSVETYKIYIFKVLKQVHPDIGISSKAMSIMNSFINDIFEKLAAESAKLARYNKKPTVTSREIQTSVRLVLPGELAKHAVSEGTKAVTKFTSS

SEQ ID NO: 256 - protein, 100 aa, Salmo salar
MELLGEYVGQDGQRQRLRVPCEAPGNADHFQGLLSGVARMKELVAELFGSPVQGEAQDRVAAAPEEALDGDDEDDAEDENNIDNRTNSDGPTAKRPKPPS

SEQ ID NO: 257 - protein, 306 aa, Triticum aestivum
MGCDGGTIPKRHELVKGPKKVEKVDKDAELVAQWNYCTLSQEILRRPIVACELGRLYNKDAVIEFLLDKSSEKALGKAASHIKSIKNVTELRLSDNPAWEGDKGSTKGDKHDDLQRARFICPVVGLEMNGRHRFCYLRCCGCVFSERALKEIKAEVCHTCGAAFQEDDVIVLNGTKEDVAMLQTRMEERRLRAKLGKKTKKPKAAESVSKSDISEEAPGPSKMKAGKPEETSLDSREKKTSSAPRSAAAHGSSSGKAGKPVCGAPKRSIADSGESEAYKSLFTTHSSAKRSKEESAHWVTHTSYCF

SEQ ID NO: 258 - protein, 153 aa, Solanum lycopersicum
MAPKAEKKPAAKKPAEEEPAAEKAEKAPAGKKPKAEKRLPAGKAEKSSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 259 - protein, 108 aa, Sus scrofa
MAATALAVRSRIGAWSVWAMQSRGFSSDTPEGVRSGAGAVRDAGGAFGKKEQADEERYFRARAREQLAALKKHHENEISHHVKEIERLQKEIERHKQSIKKLKNDDDD

SEQ ID NO: 260 - protein, 166 aa, Ovis aries
MASGVTVNDEVIKVFNDMKVRKSSTQEEIKKRKKAVLFCLSDDKRQIIVEEAKQILVGDIGDTVEDPYTSFVKLLPLNDCRYALYDATYETKESKKEDLVFIFWAPESAPLKSKMIYASSKDAIKKKFTGIKHEWQVNGLDDIKDRSTLGEKLGGNVVVSLEGKPL

SEQ ID NO: 261 - protein, 103 aa, Oryza sativa
MAKKSLIQREKKRQKLEQKYHLIRRSSKKKIRSKVSPLSLSEKTKMQEKLQSLPRNSAPTRLHRRCFLTGRPRANYRDFGLSGHILREMVYACLLPGATRSSW

SEQ ID NO: 262 - protein, 152 aa, Sus scrofa
MAPKAEKKPAAKKPAEEEPAAEKAPAAGKKPKAEKRLPAGKGEKGGAGEGKKAGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSA

SEQ ID NO: 263 - protein, 125 aa, Oryza sativa
MPTKNQLIRHGREEKRRTDRTRALDQCPQKQGVCLRVSTRTPKKPNSALRKIAKVRLSNRHDIFAYIPGEGHNLQEHSIVLVRGGRVKDLPGVKFHCIRGVKDLLGIPDRRKGRSKYGAERPKSK

SEQ ID NO: 264 - protein, 123 aa, Sus scrofa
SGSCEVKTCWWAQPDFRAIGDYLKDKYDSASEMVVEKHRESRGWVETLRAKYALFKPPTERDLVYYENSPNFCEPNPETGLFGTRDRTCNVTSHGIDGCDLLCCGRGHNTRTEKRKEKCHCIF

SEQ ID NO: 265 - protein, 295 aa, Oryza sativa
MEFWGVEVKVGQTVTVDPMDPVDSYIHISQVALGEAKKDKPNEPVVLYLKVGEQKIVLGTLSRDGIPHLSLDLVLDSDSELSHTSKSASVFFCGYKVLTGNDNASDFSDSSEEDEELALEGQDNGKPELKAEGAKVTKPSKSIPKIGAPAKAADPKKDEDDDSDDESDDDLAGEDESGSSDEMDDDSNSEEESDGDDEETPAKKVDQGKKRPNESAAKTPISAKKAKTATPEKTDGKKSVHVATPHPSKKGGKTPNSTKGQTPNSAGQLSCASCKKSFTNEAGLQQHKKAKHGGQ

SEQ ID NO: 266 - protein, 119 aa, Malus domestica
MARTSFKLEHPLERRQAESARIREKYSDRIPVIVEKADKTDVPEIDKKKYLVPADLTVGQFVYVVRKRIKLSPEKAIFVFVKNTLPPTASLMSAIYEENKDEDGFLYMTYSGENTFGSA

SEQ ID NO: 267 - protein, 146 aa, Sus scrofa
SETIDLQGGKAFGLLKAQQEGRLNEINKQFLDDPKYSSDEDLSRKLEAFKQKYMEFDLNGNGDIDIMSLKRMLEKLGVPKTHLELKKLIKEVSSGSGETFSYSIFLKMMLGKRSAILKMILMYEEKAREQEKPTGPPAKKAISELP

SEQ ID NO: 268 - protein, 151 aa, Oryza sativa
MAPKAEKKPAAKKPAEEEPATEKVEKAPAGKKPKAEKRLPAGKSKEGGEGKKGKKKAKKSVETYKIYIFKVLKQVHPDIGISSKAMSIMNSFINDIFEKLAAESAKLARYNKKPTITSREIQTSVRLVLPGELAKHAVSEGTKAVTKFTSS

SEQ ID NO: 269 - protein, 120 aa, Salmo salar
MAEPAKKKPKKLPKKDKGQKDIKRKKKESYTVKIYIFKVLKQVHPDIGISSKAMGIMNSFINDIFEKLASEASRLARYNKKSTITPREIQTAVRLLLPGEVAKHKVSEATKAVTKFTSGA

SEQ ID NO: 270 - protein, 191 aa, Oryza sativa
MSGGGTETPTGCEAPSGGGGGGGRKRDSLGTTSSPAHLIIKDLGEIHSRLLDHRPVIQGETRYFVKEFEEKRGLREMRALENLKNMIHETNEHTLPTCTETMEDSLSHVLQRLQAATASVCRLQQREQERKKVHNDHLIASEKQHIMQWEDFMKEQHSKQADVDEEHRKAMEKLKEQYAEMEKDLAKFSTF

SEQ ID NO: 271 - protein, 249 aa, Ovis aries
MAALRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTALHTKLEGFHTQISKYFSERGDAVAKAAKQPHVGDYRQLVHELDEAEYRDIRLMVMEIRNAYAVLYDIILKNFEKLKKPRGETKGMIY

SEQ ID NO: 272 - protein, 270 aa, Sus scrofa
MEDQMANLRLTDFEFFRIILPGSSKTKLKLPYKFARELGDRELREARLRVAGEGRRPWDVKVFDDDVSGDVYLGRGWQEFARAHDLRDGHFLVFRYDGAAAFTVTVFDETMCRRDYRRHHDAAESGSSSSSDSSDAAAAVATAAAEGVGDVALSQFAVTLRQCNLEDKQAQYLNVPMEFQEAHEYARREKVVLRMRGEAWTVRLKHSRRERGQRTAFRYGWHRFCVDNGLAVGDTCFFRVLREGDLRRGGAADDHVLKVAVRKADGTTLE

SEQ ID NO: 273 - protein, 317 aa, Zea mays
MRVLWVALVVTLLAGCRTEDEPGPPPEVHVWWEESKWQGSQPWEQALGRFWDYLRWVQSLSDQVQEELLSTKVTQELTELIEESMKEVKAYREELEAQLGPVTQETQARLSKELQAAQARVGADMEDVRNRLVLYRSEVHNMLGQTTEELRSRLASHLRNVRKRLVRDTEDLQKRLAVYQAGLREGAERSVSALRERLGPLVEQGRLRAATLSTRAGQPLRERAEAWGQKLRGRLEEMGSRTRDRLDEMRDELEEVRTKVEEQGSQLRLQAEAFQARLKGWFEPLVEDMRRQWAGLVERMQSAVSISSSTSAPSDNQ

SEQ ID NO: 274 - protein, 198 aa, Oryza sativa
MENQFQDGKEEVIEAWYMDDSEEDQRLPHHREPKEFIPLSKLSELGILSWRLNADDWENDENLKKIREARGYSYMDICDVCPEKLPNYEAKLKNFFEEHLHTDEEIRYCLEGSGYFDVRDQNDQWIRVAVKKGGMIVLPAGMYHRFTLDSDNYIKAMRLFVGEPVWTPYNRPHDHLPARKEYVEKIINRGGTQAVEAR

SEQ ID NO: 275 - protein, 79 aa, Sus scrofa
MSAQKSPAELKSIFEKYAAKEGDPNQLSKEELKQLIQAEFPSLLKGPRTLDDLFQELDKNGDGEVSFEEFQVLVKKISQ

SEQ ID NO: 276 - protein, 139 aa, Zea mays
MANSSSGVAIHDDCKLKFNELQSKRMHRFITFMMDNKGKEIIVDKIGDRTTSYEDFTSSLPEGDCRFAIYDFDFLTAEDVPKSRIFYILWSPDNAKVRSKMLYASSNERFKKELNGIQLEVQATDAGEISLDALKDRVK

SEQ ID NO: 277 - protein, 616 aa, Sus scrofa
MAEAKTHWLGASLSLILLIFLLATAEAASFQRNQLLQKEPDLRLENVQRFASPEMIRALEYIEKLRQQAHKEESSPDYNPYQGVSVPLQQKENSDLPESSRDSLSEDEWMKILLEALRQAENEPQSSLKENKPYTLNSEKNFPMDMPDDYETQQWPERKLEHMRFPPMYEENSRDNPFKRTNEIVEEQYTPQSLATLESVFQELGKLTGPNNQKRERVDEEQKLYTDDEDDIYKANNIAYEDVVGGEDWNPVEEKIESQTQEEVRDSKENIEKNEQINDEMKRSGQMGLQDEDLRKEGKDQLSEDVSKVIAYLKRLVNAVGSGKSQNGQNGERANRLFEKPLDSQSIYQLIELSRNLQIPPEDLIDMLKTGEKPNASVEPEQELEIPVDLDDISEVDLDHPDLFQNKMLSKNGYSKTPGRAVSEALPDGLSVEDILNLLGMENAANQKPPYFPNQYNREKILPRLPYGPGRAKANQLPKAVWMPDVENRQMAYDNLNDKDQELGEYLARMLVKYPEIMNSNQVKRVPSQGSSEDDLQEENQIEQAIKERLNQHSSQETDKLALVSKRLPVATPKSDDAPNRQYLDEDLLMKVLEYLNQEKAEKGREHIAKRAMENM

SEQ ID NO: 278 - protein, 40 aa, Spinacia oleracea
SRGISRYITKKNRHNTPSRLELRKFCPFCCKHMIHAEIKK

SEQ ID NO: 279 - protein, 91 aa, Sus scrofa
MASGQESRKELDRKAREGETVVPGGTGGKSVEAQEHLAEGRSRGGQTRREQLGQQGYSEMGKKGGLSTTDESGGERAAREGVTIDESKFTK

SEQ ID NO: 280 - protein, 207 aa, Sus scrofa
MDDNLQLGDSGVVKNVAKLGRRARLAAEQTSSLEESRHVRKSSSSTSMGEVPPPKPARRQGGWAEETSGSAKSGRRPAVVEDVEDRRLRPQTPQGSDDEGDIPVIPDLDEVQEEDLTMQVAAPPSIQVNRVMTYRDLDNDLMKYSAFQTLDGEIDLKLLTKVLAPEQEVREEDVGWDWDRLFTEVSSELLTEWDQGEKEEQVPLPVL

SEQ ID NO: 281 - protein, 152 aa, Solanum lycopersicum [sequence omitted]

SEQ ID NO: 282 - protein, 254 aa, Solanum tuberosum
MAREENVYMAKLAEQAERYEEMVQFMEKVSTSLGSEELTVEERNLLSVAYKNVIGARRASWRIISSIEQKEESRGNEEHVKCIKEYRSKIESELSDICDGILKLLDSNLIPSASNGDSKVFYLKMKGDYHRYLAEFKTGAERKEAAESTLSAYKAAQDIANTELAPTHPIRLGLALNFSVFYYEILNSPDRACNLAKQAFDEAIAELDTLGEESYKDSTLIMQLLRDNLTLWTSDMQDDGADEIKETKNDNEQQ

SEQ ID NO: 283 - protein, 83 aa, Glycine max
MCILSFLKSDQSSSYDDDEYSKPCCDLCMCTRSMPPQCSCEDIRLNSCHSDCKSCMCTRSQPGQCRCLDTNDFCYKPCKSRDD

SEQ ID NO: 284 - protein, 385 aa, Spinacia oleracea
MGLLCSRNRRYNDADAEENAQTAEIERRIEVRNERAEKHIQKLLLLGAGESGKSTIFKQIKLLFQTGFDEAELKSYLPVIHANVYQTIKLLHDGSKEFAQNDVDSSKYVISNENKEIGEKLLEIGGRLDYPYLSKELAQEIENLWKDPAIQETYARGSELQIPDCTDYFMENLQRLSDANYVPTKEDVLYARVRTTGVVEIQFSPVGENKKSDEVYRLFDVGGQRNERRKWIHLFEGVSAVIFCAAISEYDQTLFEDENRNRMMETKELFEWILKQPCFEKTSFMLFLNKFDIFEKKILKVPLNVCEWFKDYQPVSTGKQEIEHAYEFVKKKFEESYFQSTAPDRVDRVFKIYRTTALDQKVVKKTFKLVDETLRRRNLLEAGLL

SEQ ID NO: 285 - protein, 61 aa, Sus scrofa
  MOD_RES (42)..(42): Any amino acid
ILNSPDRACNLAKQAFDEAISELDSLGEESYKDSTLIMQLLXDNLTLWTSDTNEDGGDEIK

SEQ ID NO: 286 - protein, 139 aa, Solanum lycopersicum
MSNSASGMAVCDECKLKFLELKAKRSFRFIVFKINEKVQQVVVDRLGQPGESYDDFTACLPADECRYAVFDFDFVTDENCQKSKIFFISWAPDTSRVRSKMLYASSKDRFKRELDGIQVELQATDPSEMSMDIVKSRAL

SEQ ID NO: 287 - protein, 540 aa, Triticum aestivum
MEKAKLSSALFAGTHFDRKRFAGDFARFRQGPPAPDVASAAAPSPEKKRKRQSKAKAKKSKKRRAEGADSASDAVEGFSVFKGLAAKKDEDDSEKKVETGKSEDSEVVRRRKEVEREIERAAILRKKFDIHISGQNVPAPLENFEELVSRYGCDSYLVGNLSKLGFQEPTPIQRQAIPILLSGRECFACAPTGSGKTLAFLFPILMKIKPGSKEGVKAVILCPTRELAAQTTRECKKLAKGRKFYIKLMTKDLSKSGNFKDMHCDILISTPLRLDHAVQKRDLDLSRVEYLVLDESDKLFELGFVEVIDSVVKACSNPSIIRSLFSATLPDSIETLARTIMHDAVRVIVGRKNSASSLIKQKLIFAGTEKGKLLALRQSFAESLNPPVLIFVQSKERAKELYKELAFDDVRADVIHADLDEEQRQDAVDNLRAGKTWVLIATEVIARGMDFKGVNCVINYDFPESASAYIHRIGRSGRAGRSGEAITFFTEEDKPFLRNIANVLISSGCEVPSWIKALPKLKRKKHRVNRDPISTLPDED

SEQ ID NO: 288 - protein, 155 aa, Solanum tuberosum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNNDCGAGTFMANHFDRHYCGKCGLTYVYNQKA

SEQ ID NO: 289 - protein, 22 aa, Triticum aestivum
  MOD_RES (1)..(1): Any amino acid
XSGKVLSEEEKAAANVYIKKME

SEQ ID NO: 290 - protein, 100 aa, Oryza sativa
MARKSVIQREKKRQKLEQKYHLIRRSSKKEISKVPSLSDKWKIHGKLESLPRNSAPIRLHRRCFSTGRPRANYRDFGLSGHILREMVHACLLPGATRSSW

SEQ ID NO: 291 - protein, 834 aa, Oryza sativa
ENENLGDEILEDFETYWEDVNDRLMVSRMVSDSVIKGIVSAVEQEAAERLVTKDMELANLKEYLQFHEGGLSKTELESFGSLMSQNELESMDFRKCMTLSDVFMEHGKMGEFLDGLRSLAKDEFKKLKKSIDELRGSNSVSNKISRSEMAKLEGILQEKESGIWVQLDKTLDNIRMMVDTVFKRMDVMLQLSKTSLHHWQEEHLIKVELESMVMQCVIRTVQEEFEYKLWDQYAQLCGDRNEKLNAISSLRTELDAVLKSLSSSENGHVTSHGSHDADFFTRKKSSEYVTSTKSVWDGNGKLEDSKTDIPENFDAVTLKHMSKDEMVTYFNNIMTKMKRHHESILQKKTDEYFVLRAEYLNLRGGSVVPHKKDKGESDILRKKIPEIIFKLDDILVENEKHPAFTQETLSFGNLKDRLDNLLSENHQLRDLVKEKKNEVKSLLSQVSDATEKRLQHSLAEAGMLKQIGELNLAMEESLIGGSVREDVYTCFLRDLSGGARNEVEELNLGFNMINESNDTSAGSTRKIEIEDLEMECLIMQEICGVISGEGIKEAKDMLKELYLEHLNEKEIRTSLDTKLIEMENKLKFEVEEKDRLMQMEKLVNEKEKLATDASAALAKERVQSEQVRQELNAAKEFASQQQTLASGCNKEVNVIKGQLAEAVERIEVLKEEVAQLNISLEEKTEELKEANHRANMVLAISEERQTLLSSLESKEIALRKQVEKIIGNINESSKMIADFECRVTGRLKTNNARFEHSFSQMDCLVKKANLLRRTTLLYQQRLEKRCSDLKLAEAEVDLLGDEVDTLLSLVEKIYIALDHYSPVLQHYPGDYGDS

SEQ ID NO: 292 - protein, 112 aa, Oryza sativa
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 293 - protein, 113 aa, Ovis aries
MTEKKNRREKKNPREAKVTFEGLVTEALPNGMFRVRLENDTIILGYISGKIRSSSIRILMGDRVKIEVSRYDSSKGRIIYRLPHKDSKRIEDSKDSEDLKDSEDLKDTKDSKD

SEQ ID NO: 294 - protein, 248 aa, Sus scrofa
MERASLIQKAKLAEQAERYEDMAAFMKSAVEKGEELSCEERNLLSVAYKNVVGGQRAAWRVLSSIEQKSNEESSEEKGPEVQEYREKVETELRGVCDTVLGLLDTHLIKEAGDAESRVFYLKMKGDYYRYLAEVATGDDKKRIIDSARSAYQEAMDISKKEMPPTNPIRLGLALNFSVFHYEIANSPEEAISLAKTTFDEAMADLHTLSEDSYKDSTLIMQLLRDNLTLWTADNAGEEGGEAPEEPQS

SEQ ID NO: 295 - protein, 490 aa, Oryza sativa
MDGIQTSDSSHHGIVENSPYRTPYDRYAEGGQLGASWYFSRKEIEENSLSRRDGIDLKKESYLRKSYCTFLQDLGMRLKVPQVTIATAIVFCHRFFLRQSHAKNDRRTIATVCMFLAGKVEETPRPLKDVILISYEIIHKKDAAAVQRIKQKEVYEQQKELILLGERVVLVTLGFDLNVHHPYKPLVEAIKKFKVAQNALAQVAWNFVNDGLRTSLCLQFKPHHIAAGAIFLAAKFLKVKLPSDGEKVWWQEFDVTPRQLEEVSNQMLELYEQNRVAPPPSQGNDTEGSSASVVNQRASGKAPGSSEEPPTHENHLAPRQSSTPGHQGYDHPHPEKQNSSQRVPQNDARDGTANSNEGPNMSSTMDAMKKIDKDKVKAALEKRRKSKGDVAKKVDIMDDDDLIERELEHGVELAAEDEKIKHERRQSWPHSAHREDHQGVARLTENTEEGELSIDSQEYRSPELDNRKRKDMHEHRNYDRGERDLKRLRS

SEQ ID NO: 296 - protein, 136 aa, Glycine max [sequence omitted]

SEQ ID NO: 297 - protein, 90 aa, Sus scrofa
MKKKGGRKIFGFMVKEEKEENWGSVEFQVFSFTNKIRRLASHLELHKKDFSSERGLRRLLGKRQRLLAYLAKKNRVRYKKLISQLDIRER

SEQ ID NO: 298 - protein, 100 aa, Oryza sativa
MAKKSLIAREKKRKKLEEKFYLIRRYPTKEMSKGGSLSESWEIQGKLEALPRNSAPTRLHRRCFLTGRPRANVRDFGLSGHILREMVHICLLPGATRSSW

SEQ ID NO: 299 - protein, 152 aa, Zea mays [sequence omitted]

SEQ ID NO: 300 - protein, 139 aa, Solanum lycopersicum
MANSSSGLAVNDECKVKFRELKSRRTFRFIVFRIDDTDMEIKVDRLGEPNQGYGDFTDSLPANECRYAIYDLDFTTIENCQKSKIFFFSWSPDTARTRSKMLYASSKDRFRRELDGIQCEIQATDPSEMSLDIVRSRTN

SEQ ID NO: 301 - protein, 69 aa, Oryza sativa [sequence omitted]

SEQ ID NO: 302 - protein, 77 aa, Zea mays
MDLVKNHLMYAVREEVEILKEQIRELVEKNSQLERENTLLKTLASPEQLEKFQSRLSPEEPAPETPEAPEAPGGSAV

SEQ ID NO: 303 - protein, 114 aa, Oryza sativa
MAEEKHQHHHHLFHHKNKEDEGGPVDYEKEVKHHSHLEKIGELGAVAAGALALHEKHKAKKDPEHAHKHKIEEEIMAVAAVGAGGFAFHEHHQKKDAKKEKKEVEGGHHHHHHY

SEQ ID NO: 304 - protein, 88 aa, Oryza sativa
VRQELKLELKQGFKSRIEDVREEILRKRRAGKLPGDTTSILKQWWQEHSKWPYPTEDDKAKLVEETGLQLKQINNWFINQRKRNWHNN

SEQ ID NO: 305 - protein, 139 aa, Salmo salar; identical to SEQ ID NO: 233

SEQ ID NO: 306 - protein, 90 aa, Oryza sativa
MKKKGGRKIFGFMVKEEKEENRGSVEFQVFSFTNKIRRLASHLELHKKDFSSERGLRRLLGKRQRLLAYLAKKNRVRYKKLISQLDIREK

SEQ ID NO: 307 - protein, 90 aa, Oryza sativa; identical to SEQ ID NO: 297

SEQ ID NO: 308 - protein, 133 aa, Oryza sativa
MPFKRFVEIGRVALINYGKDYGRLVVIVDVIDQTRALVDAPDMERSPINFKRLSLTDLKIDIKRVPKKKDLIKALEAADVKNKWAKSSWGRKLIVKKTRAALNDFDRFKIMLAKIKRAAGVRQELAKLKKTAA

SEQ ID NO: 309 - protein, 129 aa, Oryza sativa
MQIFVKTLTGKTITLEVESSDTIDNVKAKIQDKEGIPPDQQRLIFAGKQLEDGRTLADYNIQKESTLHLVLRLRGGIIEPSLQALARKYNQDKMICRKCYARLHPRAVNCRKKKCGHSNQLRPKKKIKN

SEQ ID NO: 310 - protein, 262 aa, Sus scrofa
MSQPAELSREENVYMAKLAEQAERYEEMVEFMEKVAKTVDSEELTVEERNLLSVAYKNVIGARRASWRIISSIEQKEESRGNEDRCTLIKEYRGKIETELSKICDGILKLLDSHLVPSSTAPESKVFYLKMKGDYYRYLAEFKTGAERKDAAENTMVAYKAAQDIALAELPPTHPIRLGLALNFSVFYYEILNSPDRACNLAKQAFDEAISELDTLSEESYKDSTLIMQLLRDNLTLWTSDISEDAAEEIKEAPKGESGDGQ

SEQ ID NO: 311 - protein, 107 aa, Sus scrofa; identical to SEQ ID NO: 246

SEQ ID NO: 312 - protein, 21 aa, Sus scrofa
LDEFRVYSDDANKYKISIPQD

SEQ ID NO: 313 - protein, 719 aa, Oryza sativa
MEKNIAHCPVEGNGEIENGASSSQNPESLEHSVLLSTSQTMPNNLGIRKNYKRAANRGKKGSQGLTGQAYTLMSSNSDVRVLRSTSSSKTTSTEHVQAPVQPAAKRRKMSRASNKSSTDEFSQIRKRVRYILNRMNYEQSLIEAYASEGWKNQSLDKIRPEKELERAKSEILRCKLRIREVFRNIDSLLSKGKIDETLFDSEGEISCEDIFCSTCGSNDATLGNDIILCDGACDRGFHQNCLNPPLRTEDIPMGDEGWLCPACDCKIDCIDLINELHGSNISIEDSWEKVFPDAAAMANDSKQDDAFDLPSDDSDDNDFDPNMPEEHVVGKDEESSEEDEDGGSDSDDSDFLTCSDDSEPLIDKKVDDLRLPSEDSEDDDYDPAGPDSDKDVEKKSSSDESDFTSDSDDFCKEISKSGHDEVSSPLLPDAKVGDMEKITAQAKTTSSADDPMETEIDQGVVLPDSRRRQAERLDYKKLYDEAYGEASSDSSDDEEWSGKNTPIIKSNEEGEANSPAGKGSRVVHHNDELTTQSTKKSLHSIHGSVDEKPGDLTSNGSNSTARKGHFGPVINQKLHEHFKTQPYPSRSVKESLAEELGLTFRQVNKWFETRRHSARVASSRKGISLDKHSPQNTNSQVTASMEPKEPEGTVVEESNVCLNGGTTISKEAVSSKVGSRTPGSDVGGSKVDSAEDQNPGPDLAEKARQKAIQQELRKKKMGR

SEQ ID NO: 314 - protein, 248 aa, Oryza sativa
MSSSSLTTTSSMDSVVDGGLDTRLSLAVGCCPPRRRPVLLFGEVLPSPEKKVAAAAVVAAGKRGREQRGEAEAEATTTRQRRSCKKGRRGRGDDDDDDGDRRSPSGGGGDEEGASRKKLRLTGEQATLLEDSFRAHNILSHAEKQELAGKLGLSARQVEVWFQNRRARTKLKQTEADCDLLRRWCDHLAADNARLRRDLAELRRSSSSPPVSGLAVATPVVCPSCAHDDKRRLAFATAAAAAGDMASN

SEQ ID NO: 315 - protein, 94 aa, Oryza sativa
MASGQEKGRSELDSLAREGQTVVPGGTGGKSYEAQEKLAEGRSRGGQTRKEQMGEEGYSEMGRKGGLSTNDESGGERAAREGIDIDESKFKTKS

SEQ ID NO: 316 - protein, 270 aa, Oryza sativa
MADEEQMERKEEATEIAPFDPTKKKKKKKVVIQDPADEVDKLAEKTEGLSVTESGEASFVGLKKKKKKLVELDPSLVEAGDGEDTLDDQVGEDEQGEGIVLGGATQYPWEGTDRDYKYDELLGRVFNILRENNPDLAGDRRRTVMRPPQVLREGTKKTVFVNFMDLCKTMHRQPEHVMMFLLAEMGTSGSLDGQQRLVIKGRFAPKNFEAILRRYINEYVICHGCKSPDTILSKENRLFFLRCEQCGSSRSVAPIKAGFVAQVGRRKAGT

SEQ ID NO: 317 - protein, 384 aa, Oryza sativa
MARGEKGRGEGPAKSALRKVRTATLVINLARGWQQWANENSTRQAQEPTGWMPGGARESDQPSGPVIHPTTHQKVQSAPKSPSPKPGGYGAGQSSEGATEVSPIKRKEVTKTIVSKAYERGGDVSHLSHRYEKDGDEPEPEQPESDIDRLLRSHGSPTRRRKCANLVSELTKGWKEMEQEEQEELKCRSDSIDTEDSGYGGETEERPEQDGEQVAIARIKRPLPSQANRFTEKLNCKAQRKYSQVGHLKGRWQQWADEHIQSQKLNPFSDEFDYELAMSTRLHKGDEGYGRPKEGTRTAERAKRAEEHIYREIMDMCFIIRTMAHPRRDGKIQVTFGDLFDRYVRISDKVVGILMRARKHGLVDFEGEMLWQGRDDHVVITLLK

SEQ ID NO: 318 - protein, 196 aa, Oryza sativa
MRPKVVFVLGGPGAGKGTQCARIVEKYGYTHLSAGELLRDERKNPDSQYGELIEKYIKDGKIVPVEITISLLRREMDQTMAANAQKNKFLIDGFPRNQDNLQGWNKTMDGKADVSFVLFFDCNNEICIERCLERGKSSGRSDDNRESLEKRIQTYLQSTKPIIDLYEEMGKVKKIDASKSVDEVFDEVVKIFDKEG

SEQ ID NO: 319 - protein, 129 aa, Oryza sativa; identical to SEQ ID NO: 309

SEQ ID NO: 320 - protein, 257 aa, Oryza sativa
MSDSSREENVYMAKLADEAERYEEMVEFMEKVAKTVEVEELTVEERNLLSVAYKNVIGARRASWRIISSIEQKEESRGNEDHVAIIKEYRGKIEAELSKICDGILNLLESNLIPSAASPESKVFYLKMKGDYHRYLAEFKTGAERKEAAESTLLAYKSAQDIALADLAPTHPIRLGLALNFSVFYYEILNSPDRACNLAKQAFDEAISELDTLGEESYKDSTLIMQLLRDNLTLWTSDITDIAGDEIKETSKQQPGE

SEQ ID NO: 321 - protein, 312 aa, Solanum lycopersicum
MNPLTQVKRTQVINQKEALLGIGEDGSWHAKFKDSAYVFVGGIPYDLTEGDLLAVFAQYGEVVDVNLVRDKGTGKSKGFAFLAYEDQRSTILAVDNLNGAKVLGRIVRVDHVSKYKKKEEEDEEELQKKREARGVCYAFQKGECNRGASCRYSHDEQRNANTGWGSKEESKARWEHDRHHEPPMSHKKFPSSAGEQRFPDRAKEENKSTGREGQSSRSEAYKDRDSRLRHSDRGSKDHDRYRHDRSPERSRGDRQRNNDRYAQGRDEKSERYRSEVKHDEGDQKRSRRDTDSSGHYERRGNEDSERYRKSRR

SEQ ID NO: 322 - protein, 654 aa, Solanum tuberosum
MVLSDLDIKEPDSPESGLNGSDDMVREHETESKGNLYSQYEEKVRPCIDLIDSLRALGVEQDLALPAIAVIGDQSSGKSSVLEALSGVALPRGSGIVTRCPLVLRLKKLEKEGEWKGKVSFLDREIEISDASQVEKEISEAQIAIAGEGMGISHELISLEVSSPHVPDLTLIDLPGITRVAVGNQPHDIEYQIKSLIRKYILRQETINLVVVPANVDIATTEALRMAQDVDPQGDRTIGILTKPDLVDKGTEDKVVDVVRNLVFHLKKGYMIVKCRGQQEIQHRLSLDKALQRERIFFEDHTHFRDLLEEGRATIPCLAERLTNELIMHICKTLPLLENQIKETHQRITEELQKYGKDIPEEESEKMFSLIEKIDTFNKEIISTIEGEEHVGQYDSRLFTKVRAEFCKWSAVVEKNFEKGHEAIRKEIKQFENRYRGRELPGFVNYKTFEIIIKKQVIVLEEPAVDMLHTVTDIIRNTFTEVSGKHFSEFFNLHRTAKSKIEDIRLEQENEAEKSIRLHFQMEQLVYCQDQVYRRALQQVREKEAEEEKKKKSNHYYQSEDSEPSTAEIFQHLMAYHQEVSTRISSHIPLIIQFFVLRTYGEQLKKSMLQLLQDKDQYDWLLKERTDTRDKRKFLKERLERLSRARQRLAKFPG

SEQ ID NO: 323 - protein, 551 aa, Sus scrofa
MEEAELVKERLQAITDKRKIQEEISQKRLKIEEEKLRHQHLKKKALREKWLLDGIGSRKEQEEMKKQNQQDQHQIQVLEQSILRLEKEIQDLEKAELQISTNEEAILKKLKSVERTTEDIIRSVKVEKEETSGASIEDIYANIPDLPKSYVPSRLRKERNEGIEDDEQNRKALYAMEIKVEKDLKTGESTVLSSIPLPSDDFKGTGIKVYDDGQKSVYAVSSNHSAAYNGTDGLAPVEVEDLLRQASERNSKSPTEYHDPVYANPFCRPTTPQREKATPGPNFQERIKMKARGLGKDMNGSIHTMNNGLSEERGSSVNHISPIRPIPHPRSMTQQAEERPHSPQKRQMTPWEESDVTQDKCAPSAKSQLSPGEAPVGKSERQGSSPTCQEDEEDVRYNIVHSLPSDVEDTEPVTMIFMGYQRADDSEEEKKLLTGYDGIIRAELVVIDDEEEEGEGEAEKPSYHPIAPHSQVFQPAKPTPLPRKRAEVNPHENTNHKSPHKNSISLKEQEESLGSPIHQSPLDIQIAGDGTEDPSLTALRMRMAKLGKKVI

SEQ ID NO: 324 - protein, 110 aa, Zea mays
MAKGTRKPRQPRRVAVRFASRMKGRKKTLWQRRYRGSVKAPNMTMRVRRPLKGTLRKKIRSYATPSKKVKNTREPNCFLRSCAREKLNQSRKRYQNMRQSQRRGQNQKRR

SEQ ID NO: 325 - protein, 145 aa, Oryza sativa
MPKIKTSGVKYPDGWELIEPTLSELHSKMREAENDPHDGRRKCEALWPIFKINHQRSRYLYDLYYNRKEISQELYEFCLDQGHADRNLIAKWKKQGYERLCCLRCIQTRDHNFATTCVCRVPKHLREEQVIECVHCGCKGCASGD

SEQ ID NO: 326 - protein, 155 aa, Solanum lycopersicum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKHKKVKLAVLQFYKVDDATGKVTRLRKECPNTECGAGVFMANHFDRHYCGKCGLTYVYNQKA

SEQ ID NO: 327 - protein, 129 aa, Oryza sativa
MSYISGARSLPDEQVRIASTKMDGIGPKKAIQLRYRLGISGNIKIHELTKYQIDQIEQMIAQDHVVHWELKRGERADIERLISISRYRGIRHQDGSPLRGQRTHTNARTARKQIRKGNERRLPKEQATD

SEQ ID NO: 328 - protein, 262 aa, Ovis aries
MAVGKNKRISKGKKGSKKKTVDPFAKKDWYDIKAPSVFNVRNIGKTLVSRTQGTKIASEGLKHRVFEVSLADLQNDEDQAYRKIRLRAEDVQGKNVLTNFWGMSFTTDKLRSLVKKWQTLIEAHVDVKTTDGYMLRLFCIGFTKRRPNQVKRTCYAQASQIRQIRRKMVEIMANQASSCDLKELVSKFIPEVIGKEIEKATSSIFPLQNVFVRKVKILKAPKFDLGKLMEVHGDYAKEDIGTKLDRPAEDEAMAGQEVAAAE

SEQ ID NO: 329 - protein, 233 aa, Oryza sativa
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKAEPMDADDSNNCTGQSDQQRENSGHRRDQIIEKDAALCVLIDEMNERP

SEQ ID NO: 330 - protein, 192 aa, Sus scrofa
MATPYVEDESGKYIAATQRPDGTWRKPRKVKDGYTPQEEVPVYENKFVKFFKGKPDLPPGMSPGDEAQARQQQQGIPGIAESETAGLSKTAKRNMKRKEKRKLQGPDSNVEALINAVEMPTSNPAEATNDPSGAAAEKAKKIKNLKKKLRQVEELQQKLDSGEIKQATKEQLDKLGRAKAIQDGLLQLEEDS

SEQ ID NO: 331 - protein, 128 aa, Glycine max
MTRIKRGYIARRRRTKIRLFASSFRGAHSRLTRTITQQKIRALVSAHRDRDRKKRDFRRLWITRINAVIRERGVSYSYSRLIHDLYKRQLLLNRKILAQIAISNRNCLYMISNEIIKEVDWKESTRII

SEQ ID NO: 332 - protein, 366 aa, Oryza sativa
MPPKKAAPSKADLAKKQKVVEDKTFGLKNKNKSKNVQKYVQSLHQAVQPKPDPTKTAAKKKKEEEKAREKELNDLFKVAVSQPKVPVGVDPKSIVCEFFKVGQCQKGFKCKFSHDLNVQRKGEKIDIYTDKRDAETMEDWDQETLEKVVASKGAEYQQNKPTDIVCKYFLDAVEKKQYGWFWVCPNGGKDCHYRHALPPGYVLKSQMKALLEEESEKIAIEDEIEDQRKKVKTTTPMTTDLFMEWKRKKAEEREAGLAALRAERAKNDRMSGRELFMADSSVFVDDAEAYDVYERQEESEANEEPSNKNQDEGPSSSTSNGKEVEESDDEDINIDDDLDIDELNELEASLSRTSIQIREPGEGTSS

SEQ ID NO: 333 - protein, 88 aa, Oryza sativa
EDNDLKNRLLNKYSGYLSSLWRELSRKKKKGKLPRDARQKLLHWWQLHYRWPYPSELEKAALAESTGLEAKQINNWFINQRKRHWKQA

SEQ ID NO: 334 - protein, 85 aa, Solanum lycopersicum
ELKEMLLKKYSGCLSRLRSEFLKKRKKGKLPKDARTVLLEWWNTHYRWPYPTEEDKVRLAAMTGLDPKQINNWFINQRKRHWKPS

SEQ ID NO: 335 - protein, 87 aa, Oryza sativa
MVKNSVISVIFQKEKKGSVEFQVFNFTNKIRRLTSHLELHKKDYLSQRGLKKILGKRQRLLAYLAKKNRVRYKELINQLDIRETKTR

SEQ ID NO: 336 - protein, 266 aa, Pisum sativum
MAVGKNKRLTKGGKKGAKKKIVDPFSKKDWYDVKAPAMFNIRNIGKTLVSRTQGTRIASDGLKGRVFEVSLADLQNDEVAFRKFKLISEDVQGKNCLTNFHGMDLTRDKMCSMVKKWQTMIEAHVDVKTTDGYLLRLFCVGFTKKRTNQIRKTSYAQHQQVRQIRKKMMEIMTREVQTNDLKEVVNKLIPDSVGKDIEKACQSIYPLHDVYVRKVKMLKKPKFELGKLMELHGEGGGSSAAKPSGDDTGAKVDRADGYEPPIQETV

SEQ ID NO: 337 - protein, 153 aa, Zea mays
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGQ

SEQ ID NO: 338 - protein, 138 aa, Zea mays
MEKFLKPNKAVILLQGKYAGRKAVIVRAFDEGTRDRPYGHCLVAGISRYPKKVIRKDSAKKAGKKSRVKAFIKLVNYNHIMPTRYTLDEDLKDVVKDVVNADVLQARDKKVTARRTKARLAERFKTGKNRWFFTKLRF

SEQ ID NO: 339 - protein, 49 aa, Meleagris gallopavo
QTLELEKEFHFNRYLTRRRRIEIAHALCLSERQIKIWFQNRRMKWKKDN

SEQ ID NO: 340 - protein, 138 aa, Oryza sativa
MKMSAEQISEVLKEGELEKRSDNLLQFWKRKTCVLTTDSLNIYADTQKRTKSKELKLQSIKKVDCVERTGKFVYFTIVTTDNKEIDFRCSGDDNCWNAVITMALIDFQNRKAIQDFKTRQDDESGSPGQHESRMARAP

SEQ ID NO: 341 - protein, 175 aa, Oryza sativa
MADVLDLHEAGGEDFAMDEDGDDSIHKLKEKAKRRKGRGFGSEEGARSRVREDYDTVEQDGDEPGPQRSVEGWILFVTGVHEEATEEDIHDKFAEFGEIKNLHLNLDRRTGYLKGYALVEYETYKEAQAAMEGLNGQDMMGQPISVDWGFVRGPPKSKRRGGGRRRSRSPDRRRR

SEQ ID NO: 342 - protein, 139 aa, Oryza sativa
MANAASGMAVDDECKLKFLELKAKRTYRFIIYKIDEKKKMVVVEKVGEPVLNYDDFAASLPANECRYAIFDYDFVTEENCQKSKIFFIAWSPDTSRVRSKMIYASSKDRFKRELDGIQVELQATDPTEVGLDVIRGRAN

SEQ ID NO: 343 - protein, 93 aa, Oryza sativa
MASGQQERSQLDRKAREGETVVPGGTGGKSLEAQENLAEGRSRGGQTRREQMGEEGYSQMGRKGGLSTNDESGGDRAAREGIDIDESKFKTKS

SEQ ID NO: 344 - protein, 609 aa, Oryza sativa
MASAGDRRGGGGPPGSGDDSGGGWETVEKRVKKPAQQVGKGQWGQWNSPNAAPAPTAPRSGSGAFHHSGNTLVRHSDRRPARGTPRPPPQNRSIEAELQAPHGVVTAPLANGWQWGARSCPPGTESKEGGLPLSGCDPETDNAEGYDTSDDDNDDDMSDDLSDDYDSDASEKSFETRKNHKLFKGFFEVLEALSVEQLNEPTRQWHCPACKNGPGAIDWYKGLQPLMTHAKTKGSIKVKRHRELASLLEEELSRRGTSVVPSGEQFRKWKGLRESTDREIVWPPMVVVMNTVLEQDEDDKWKGMGNQELIDYFSEYAASKARHAYGPNGHRGMSVLIFDSSAVGYMEAERLHDHFVRQRTDRNTWNSAHKVTFLPGGKRQLYGFLATKDDMETFNRHCHGKSRLKYEMRSYNEMVVTQMKQMSEDNQQLNYLKNKMVKKEQHSKLVEDTLSVVTQKLRETMEENTIVRNKAKEKHLEYEKEMKYQEEFFHDQIEKIHKATEEKEIKFEKLLQEERAKARQSDVDSGSTEDRRQRKEKIQNFIDCQVKDVEEFEAERDKLIKLHEEKKVKLKKEYLAKEFELEKELDTALTSLMDKHKPDIFKSSTSPST

SEQ ID NO: 345 - protein, 384 aa, Oryza sativa
MGSLCSRNKHYSQADDEENTQTAEIERRIEQETKAEKHIQKLLLLGAGDSGKSTIFKQIKLLFQTGFDEEELKNYIPVIHANVYQTTKILHDGSKELAQNELEASKYLLSAENKEIGEKLSEIGGRLDYPHLTKDLVQDIEALWKDPAIQETLLRGNELQVPDCAHYFMENLERFSDVHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVPKVPLNACEWFKDYQSVSTGKQEIEHAYEFVKKKFEESYFQCTAPDRVDRVFKIYRTTALDQKLVKKTFKLVDETLRRRNLFEAGLL

SEQ ID NO: 346 - protein, 202 aa, Solanum lycopersicum
MATPYVEDQSGKYIAATQRPDGTWRKPRRVKDGYTPQEEVPVYENKFVKFFKGKPDLPPGMSPGNAAQARQQQGIPGIAENEIAGLSKTAKRNMKRKEKRKQQGPDSNVELLTNAVETMTFAEDGDNVTPASNPAGATYDPSSAIAEKAKKIKNIKKKLRQVEELQQKLDSGEIKQATKEQQEKLGRAKALQGELLQLEEDS

SEQ ID NO: 347 - protein, 145 aa, Oryza sativa
MPKIKTSRVKYPGGWELIEPTIRELDAKMREAENDTHDGKRKCEALWPIFRISHQRSRYIYDLYYRRKEISKELYEFCLDQGYADRNLIAKWKKPGYERLCCLRCIQTRDHNFATTCVCRVPKHLREEKVIECVHCGCRGCASGD

SEQ ID NO: 348 - protein, 261 aa, Oryza sativa
MASAELSREENVYMAKLAEQAERYEEMVEFMEKVAKTVDSEELTVEERNLLSVAYKNVIGARRASWRIISSIEQKEEGRGNEDRVTLIKDYRGKIETELTKICDGILKLLESHLVPSSTAPESKVFYLKMKGDYYRYLAEFKTGAERKDAAENTMVAYKAAQDIALAELAPTHPIRLGLALNFSVFYYEILNSPDRACSLAKQAFDEAISELDTLSEESYKDSTLIMQLLHDNLTLWTSDISEDPAEEIREAPKHDLSEGQ

SEQ ID NO: 349 - protein, 188 aa, Sus scrofa
MTEYKLVVVGAGGVGKSALTIQLIQNHFVDEYDPTIEDSYRKQVVIDGETCLLDILDTAGQEEYSAMRDQYMRTGEGFLCVFAINNTKSFEDIHHYREQIKRVKDSEDVPMVLVGNKCDLPSRTVDTKQAQDLARSYGIPFIETSAKTRQGVDDAFYTLVREIRKHKEKMSKDGKKKKKKTKTKCIIM

SEQ ID NO: 350 - protein, 93 aa, Sus scrofa
MASGQQERSELDRMAREGETVVPGGTGGKSLEAQEHLADGRSRGGETRKEQLGEEGYREMGRKGGLSTMEESGGERAAREGIEIDESKFKTKS

SEQ ID NO: 351 - protein, 152 aa, Triticum aestivum; identical to SEQ ID NO: 262

SEQ ID NO: 352 - protein, 135 aa, Oryza sativa [sequence omitted]

SEQ ID NO: 353 - protein, 129 aa, Oryza sativa
MAQNKTIAVALLLATLVAVMGKEPETLEETLRAGCKEECSEQKKKAPIDEKQCEDFCFIKTKSIFEAHKGVKDLKADRFIDFCNNECNAVYKEDPATSKKCAESCEADAKEAEVFLDKVVAYMQTMKQA

SEQ ID NO: 354 - protein, 384 aa, Solanum tuberosum
MGSLCSRNKHYSQADDEENTQTAEIERRIEQETKADKHIQKLLLLGAGDSGKSTIFKQIKLLFQTGFDEAELKNYIPVIHANVYQTIKILHDGSKELAQNELEASKYLLSAENKEIGEKLSEIGGRLDYPRLTKDLVQDIEALWKDPAIQETLLRGNELQVPDCAHYFMENLERFSDIHYIPTKEDVLFARIRTTGVVEIQFSPVGENKKSGEVYRLFDVGGQRNERRKWIHLFEGVTAVIFCAAISEYDQTLFEDERKNRMMETKELFEWVLKQPCFEKTSFMLFLNKFDIFEQKVLKVPLNTCEWFKDYQSVSTGKQEIEHAYEFVKKKFEESYFQCTAPDRVDRVFKIYRTTALDQKLVKKTFKLVDETLRRRNLFEAGLL

SEQ ID NO: 355 - protein, 304 aa, Sus scrofa
MSLQGGFVKTQKTHAYFKRFQVKFKRRRQGKTDYRARIRLTNQDKNKYNTPKYRFVTNKDITAQIVYATIAGDIVMAAAYSHELPRYGLEVGLTNYAAAYCTGLLLARRVLTLRGLDQEYEGNVEATGEDYYVEPADERRPFRALLDVGLIRTTTGNRVFGALKGALDGGLDIPHSDKRFAGFKKDEKQLDSDIHRKYIYGGHVADYMRSMAEEEPEKFQAHFSEYLKKGIDADGMESLYKKVHAAIRADPTMAKSTKKEPATHKRYNLKKLTYEQRKASLVERLNALNSSAGADDDDEEEDDE

SEQ ID NO: 356 - protein, 93 aa, Sus scrofa
MDKSMLGDLDGLPEEDKMRMAAMVDQLQIRDSLRMYNSLVERCFTDCVDTFRRKTLDKQEESCVRRCAEKFLKHSMRVGMRFAELNQGVATPD

SEQ ID NO: 357 - protein, 119 aa, Sus scrofa; identical to SEQ ID NO: 266

SEQ ID NO: 358 - protein, 92 aa, Oryza sativa
MANPLRSEVRQLYKNLLFLGREYPKGADYFGERLKRAFMKNKDVTDPKEIKKLVDRGEFVIKELEALYYLRKYRAMKKRYYEEELSTMLNIG

SEQ ID NO: 359 - protein, 303 aa, Oryza sativa
MRIAVIAFCLWGFASALPVKQTNSGSSEEKLLSNKYTDAVATLLKPDPSQKQTFLAPQNTISSEETDDFKQETLPSKSNESPEQTDDVDDDDDEDHVDSRDTDSEEADHADDADRSDESHHSDESDELVTDFPTDTPATDVTPAVPTGDPNDGRGDSVVYGLRSKSKKFRRSEAQQLDATEEDLTSHVESEETDGTPKAILVAQRLHVASDLDSQEKDSQETSQPDDRSVETRSQEQSKEYTIKTYDGSNEHSNVIESQENPKVSQEFHSHEDKLVPDSKSEEDKHLKLRVSHELESASSEIN

SEQ ID NO: 360 - protein, 140 aa, Oryza sativa
MAPKAEKKPAEKKPAEEKKAEKTPKAGKKLPKESGSSGADKKKKKSKKSIETYKIYIFKVLKQVHPDIGISSKSMGIMNSFINDIFEKLAQESSRLARINKKPTITSREIQTAVRLVLPGELAKHAVSEGTKAVTKFTSS

SEQ ID NO: 361 - protein, 77 aa, Sus scrofa
MKEQKWIHEGLITESLPNGMFWVRLDNEDPILGYVSGRIRRSSIRILPGDRVKIEVSRYDSTRGRIIYRLRNKDSND

SEQ ID NO: 362 - protein, 382 aa, Oryza sativa
MGIKGLTKLLADNAPKSMKENKFESYFGRKIAIDASMSIYQFLIVVGRSGTEMLTNEAGEVTSHLQGMFSRTIRLLEAGIKPVYVFDGKPPDLKKQELAKRYSKRAEATEDLSEALETANKEDIEKFSKRTVKVTKQHNDDCKRLLRLMGVPVVEAPSEAEAQCAALCKAGKVYGVVSEDMDSLTFGAPKFLRHLMDPSSKKIPVMEFEVAKILEELNMTMDQFIDLCILSGCDYCDSIRGIGGLTALKLIRQHGSIENIPENLNKERYQIPDNWPYQEARRLFKEPLVITDEKELDIKWSSPDEEGLITFLVNENGFNRDRVTKAIEKIKVAKNKSSQGRLESFFKPTANPSVPIKRKETPVNNAKETNKKTKAGGGKKKK

SEQ ID NO: 363 - protein, 212 aa, Oryza sativa
  MOD_RES (120)..(121): Any amino acid
PDLSAETPVFPGNCDEQPLTENPRKYVMGHFRWDRFGRRNGSSSFGAGGAAQKREEEVAVGEGPGPRGDGAETGPREDKRSYSMEHFRWGKPVGKKRRPVKVYPNGAEDESAQAFPLEFXXELTGERLEQARGPEAQAESAAARAELEYGLVAEAEAAEKKDSGPYKMEHFRWGSPPKDKRYGGFMTSEKSQTPLVTLFKNAIIKNAHKKGQ

SEQ ID NO: 364 - protein, 255 aa, Oryza sativa
MDDREDLVYQAKLAEQAERYDEMVESMKKVAGMDVELTVEERNLLSVAYKNVIGARRASWRIISSIEQKEENKGGEDKLKMIREYRQMVETELKLICCDILDVLDKHLIPAANTGESKVFYYKMKGDYHRYLAEFATGNDRKEAAENSLVAYKAASDIAMTELPPTHPIRLGLALNFSVFYYEILNSPDRACRLAKAAFDDAIAELDTLSEESYKDSTLIMQLLRDNLTLWTSDMQGDGEEQNKEALQDVEDENQ

SEQ ID NO: 365 - protein, 135 aa, Ovis aries
MGRVRTKTVKKAARVIIEKYYTRLGNDFHTNKRVCEEIAIIPSKKLRNKIAGYVTHLMKRIQRGPVRGISIKLQEEERERRDNYVPEVSALDQEIIEVDPDTKEMLKLLDFGSLSNLQVTQPTVGMNFKTPRGAV

SEQ ID NO: 366 - protein, 129 aa, Oryza sativa
MAQNKTIAVALLLATLVAVMGKEPETLEEAVRAGCKEECSEQKKKAPIDEKQCEDFCFIKTKSIFEAHKGVKDLKADRFIDFCNNECNAVYKEDPATSKKCAESCEADAKEAEVFLDKVVAYIQTTKQA

SEQ ID NO: 367 - protein, 139 aa, Sus scrofa
MANSASGMAVGDECKLKFQELKSKRSFRFITFKIDERTQQVVVDRLGQPGDTYDDFTASMPASECRYAVFDFDFVTDENCQKSKIFFISWSPDTSKVRSKMLYASSKDRFKRELDGIQVELQATDPSEMSMDIVKARAL

SEQ ID NO: 368 - protein, 90 aa, Solanum lycopersicum
MVKNSIIPVISQEKKEKNPGSVEFQIFKFTDRIRRLTSHFELHRKDYLSQRGLRKILGKRQRLLSYLSKKDRIRYKKLINQFDIRESQIR

SEQ ID NO: 369 - protein, 121 aa, Zea mays
MSQKQEEENPAEETGEEKQDTQEKEGILPEKAEEAKLKAKYPSLGQKPGGSDFLMKRLQKGQKYFDSGDYNMAKAKMKNKQLPSAGPDKNLVTGDHIPTPQDLPQRKSSLVTSKLAGGQVE

SEQ ID NO: 370 - protein, 129 aa, Solanum lycopersicum; identical to SEQ ID NO: 366

SEQ ID NO: 371 - protein, 256 aa, Sus scrofa
MSREENVYMAKLAEQAERYEEMVEYMEKVAKTVDVEELTVEERNLLSVAYKNVIGARRASWRIVSSIEQKEEGRGNEEHVTLIKEYRGKIEAELSKICDGILKLLDSHLVPSSTAAESKVFYLKMKGDYHRYLAEFKTGAERKEAAESTMVAYKAAQDIALADLAPTHPIRLGLALNFSVFYYEILNSPDKACNLAKQAFDEAISELDTLGEESYKDSTLIMQLLRDNLTLWTSDLTEDGGDEVKEASKGDACEGQ

SEQ ID NO: 372 - protein, 194 aa, Glycine max
MEEKLKKSKIIFVVGGPGSGKGTQCEKIVQKYGYTHLSTGDLLRAEVSSGSARGKMLSEIMEKGQLVPLETVLDMLRDAMVAKVDTSKGFLIDGYPREVKQGEEFERKIGQPTLLLYVDAGPETMTKRLLKRGETSGRVDDNEETIKKRLETYYKATEPVIAFYEKRGIVRKVNAEGSVDDVFSQVCTHLDTLK

SEQ ID NO: 373 - protein, 259 aa, Oryza sativa
MDRRAEFKRWKAQCLSKADFSRKGCVDEDVVEIVQLLNGREQFFTTSSCAGRIILLEQGMDSLEVQKQNCCWLLVSHKPCVKDDVIVALKKANGDAILKFEPLVLHVQCRQLQDAQILHSVAIDSGFRNSGITVGKRGKTMLAVRSTHGLEVPLSHKGKLMVTEEYIDFLLKIANHKMEENKKRIERFYNCLQLALEKETTTTNSHPKEKIKEKNNSYKKKSNPGKAHDKCVTEENDKVLENDDDDDPGISVTIFPEDY

SEQ ID NO: 374 - protein, 90 aa, Oryza sativa
MKKNSFISVISDEKKEENKGSVEFQVFCFTNKIRRLTLHLELHKKDYSSQRGLRKTLGKRQRLLAYLLKINGVRYKELISKLNIRELKTR

SEQ ID NO: 375 - protein, 76 aa, Sus scrofa
NKELDPVQKLFVDKIREYRTKRQTSGGPVDAGPEYQQDLDRELFKLKQMYGKADMNTFPNFTFEDPKFEAVEKPQS

SEQ ID NO: 376 - protein, 260 aa, Zea mays
MSPAEASREENVYMAKLAEQAERYEEMVEFMEKVAKTTDVGELTVEERNLLSVAYKNVIGARRASWRIISSIEQKEESRGNEAYVASIKEYRSRIETELSKICDGILKLLDSHLVPSATAAESKVFYLKMKGDYHRYLAEFKSGAERKEAAENTLVAYKSAQDIALADLPTTHPIRLGLALNFSVFYYEILNSPDRACNLAKQAFDDAIAELDTLGEESYKDSTLIMQLLRDNLTLWTSDNAEDGGDEIKEAAKPEGEGH

SEQ ID NO: 377 - protein, 104 aa, Solanum lycopersicum
  MOD_RES (32)..(32): Any amino acid
  MOD_RES (67)..(67): Any amino acid
MGVDIRHNKDRKVRRKEPKSQDIYLRLLVKLXRFLARRTNSTFNQVVLKRLFMSRTNRPPLSLSRMXRKMKLPGREGKTAVVVGTITDDVRFQEVPKLKVCALR

SEQ ID NO: 378 - protein, 88 aa, Solanum tuberosum
VRQELKHELKQGYRDKLVDIREEILRKRRAGKLPGDTASTLKAWWQAHSKWPYPTEEDKARLVQETGLQLKQINNWFINQRKRNWHNN

SEQ ID NO: 379 - protein, 229 aa, Oryza sativa
MAAILARKSLSALRSRQLVLAGHTIEGTNGYNRTLLGTRSFATKHSFSTDKDDEEREQLAKELSKDWNSVFERSINTLFLTEMVRGLMLTLKYFFEKKVTINYPFEKGPLSPRFRGEHALRRYATGEERCIACKLCEAICPAQAITIEAEEREDGSRRTTRYDIDMTKCIYCGFCQEACPVDAIVEGPNFEFATETHEELLYDKEKLLENGDRWETEIAENLRSESLYR

SEQ ID NO: 380 - protein, 88 aa, Spinacia oleracea
MVKLRLKRCGRKQRAVYRIVAIDVRSRREGRDLQKVGFYDPIKSQTYLNVPAILDFLEKGAQPTETVYDILKRAEVFKEFRLNQTKFN

SEQ ID NO: 381 - protein, 103 aa, Pisum sativum; identical to SEQ ID NO: 203

SEQ ID NO: 382 - protein, 53 aa, Solanum tuberosum
LAAADLAQIPDVDIDSDGVFKKWAEYHADIYDKGLDCECLGGGRSVTWADDGY

SEQ ID NO: 383 - protein, 192 aa, Sus scrofa
MYTARRKIQKDKGLEPTEFEDTVAQAFFDLENGNQELKSDLKDLYINGAVQMDLPGNRKAVIIYVPYRLRKAYKKIHVRLVRELEKKFSGKDVVLVATRRIVRPPKKGSAVVRPRTRTLTAVHDGILEDVVYPAEIVGKRVRYHLDGRKIMKIFLDPKERNNTEYKLDTFSSVYRRLCGKDVVFDYPMTETA

SEQ ID NO: 384 - protein, 85 aa, Oryza sativa
ELKHQLLRKYGGYLGGLRQEFSKRKKKGKLPKEARQKLLHWWELHYKWPYPSETEKMALAETTGLDPKQINNWFINQRKRHWKPA

SEQ ID NO: 385 - protein, 85 aa, Oryza sativa
MLKLRLKRCGRKQRAVYRIVAIDVRSRREGRDLRKVGFYDPIKNQTCLNVPAILYFLEKGAQPTRTVSDILRKAEFFKEKERTLS

SEQ ID NO: 386 - protein, 283 aa, Pisum sativum
MEPLPEPTSRPRLRPRPRCLLLLPLLLLLLLLLPAPELGPREARAEETDWVRLPSKCEVCKYVAVELKSAFEETGKTKEVIDTGYGILDRKASGVKYTKSDLRLIEVTETICKRLLDYSLHKERTGSNRFAKGMSETFETLHNLVHKGVKVVMDIPYELWNETSAEVADLKKQCDVLVEEFEEVIEDWYRNHQEEDLTQFLCANHVLKGKDTSCLAEQWSGKKGDTAALGGKKSKKKSSRAKASGGGSKQRKELGGIEGDPSPEEDEGIQKASPLTHSPPDEL

SEQ ID NO: 387 - protein, 258 aa, Spinacia oleracea
MNNLNDPPNWNIRPNSRADGGDGSRWNYALLVPMLGLAAFRWIWSRESQKEIEKEKEACRQRTAAFQRDLEARYHATISESRRAVARLSLELEKEQNRTTSYREALISQGRKMVEEKKLLEQERAQVLQEKRQPLRSAYLSCLDKEADWQRRARLLLREFEEALAERQSIYCSLVLPRGRRLDIEKGLLVRASTDPLAVDLEMAAGLSDIFKHDTHCGGVWNTSKRQNGRLMWLYLQYWELVVELKKFKRVEKAILEK

SEQ ID NO: 388 - protein, 148 aa, Triticum aestivum
NHMESHKLTSKAEKAIECDECGKHFSHAGALFTHKMVHKEKGANKMHKCKFCEYETAEQGLLNRHLLAVHSKNFPHICVECGKGFRHPSELKKHMRIHTGEKPYQCQYCEYRSADSSNLKTHVKTKHSKEMPFKCDICLLTFSDTKEV

SEQ ID NO: 389 - protein, 448 aa, Sus scrofa
MGQGTPGGMGKQGGAPGDRKPGGDGDKKDRKFEPPAAPSRVGRKQRKQKGPEAAARLPNVAPLSKCRLRLLKLERVKDYLLMEEEFVAAQERLRPTEDKTEEDRSKVDDLRGTPMSVGSLEEIIDESHAIVSSSVGPEYYVGILSFVDKDQLEPGCSILMHNKVLSVVGILQDEVDPMVSVMKVEKAPLESYADIGGLDAQIQEIKEAVELPLTHPELYEDIGIRPPKGVILYGEPGTGKTLLAKAVANSTSATFLRVVGSELIQKYLGDGPKLVRELFRVADELSPSIVFIDEIDAVGTKRYDAHSGGEREIQRTMLELLNQLDGFDSRGDVKVILATNRIESLDPALLRPGRIDRKIEFPLPDIKTRRRIFQIHTSKMTLADDVNLEEFVMTKDEFSGADIKAICTEAGLLALRERRMKVTHADFKKAKEKVMFKKKEGVPEGLYM

SEQ ID NO: 390 - protein, 166 aa, Zea mays
MASGVAVSDGVIKVFNDMKVRKSSTPEEVKKRKKAVLFCLSEDKKNIILEEGKEILVGDVGQTVDDPYATFVKMLPDKDCRYALYDATYETKESKKEDLVFIFWAPECAPLKSKMIYASSKDAIKKKLTGIKHELQANCYEEVKDRCTLAEKLGGSAVISLEGKPL

SEQ ID NO: 391 - protein, 90 aa, Glycine max
MKKKGGRKIFGFMVKEEKEENRGSVEFQVFSFTNKIRRLASHLELHKKDFSSERGLRRLLGKRRRLLAYLAKKNRVRYKKLIGQLNIREQ

SEQ ID NO: 392 - protein, 136 aa, Zea mays
MAPKAEKKPAAEKKPVETEKKPKAEKRVPGKDGGADKKKKKAKKSVETYKIYIFKVLKQVHPDIGISSKAMSIMNSFINDIFEKLAGESAKLARYNKKPTITSREIQTAVRLVLPGELAKHAVSEGTKAVTKFTSS

SEQ ID NO: 393 - protein, 215 aa, Oryza sativa
MDDHLKLGDSGVVKNVARLGRRGQRARQAAEQTSLEEPRHVRKSSSSTSMGEGPPPKPARRQGGWAEETSGSAKSGRRPAMVQDVEDRRLRPQTPQGSDGEGDIPVIPDLDEVQEEDLNMQVAAPPSIQVNRVMTYRDLDNDLMKYSAFRTLDGEIDLKLLTKVLAPEQEVREEDVGWDWDHLFTEVSSELLTEWDQGEKEEQVCVMRTSLPKMG

SEQ ID NO: 394 - protein, 69 aa, Salmo salar
MPKQIHEIKDFLLTARRKDARTVKIKKNKDMVKFKVRCSKYLYTLCVSDFEKADKLKQSLPPGLSVQDL

SEQ ID NO: 395 - protein, 85 aa, Ovis aries
ELKNELKQGYKEKLVDIREEIMRKRRAGKLPGDTASVLKAWWQAHSKWPYPTEDDKARLVQETGLQLKQINNWFINQRKRNWHSN

SEQ ID NO: 396 - protein, 198 aa, Oryza sativa; identical to SEQ ID NO: 274

SEQ ID NO: 397 - protein, 147 aa, Triticum aestivum
MAAQRLGKRVLSKLQSPSRARGPGGSPGGLQKRHARVTVKYDRRELQRRLDVEKWIDGRLEELYRGREADMPDEVNIDELLELESEEERSRKIQGLLKSCTNPTENFVQELLVKLRGLHKQPGLRQPSPSGDGSLSPRQDRARTAPP

SEQ ID NO: 398 - protein, 125 aa, Sus scrofa
MPTKNQLIRHGREEKQRTDRTRASDQCPQKQGVCLRVSTRTPKKPNSALRKIAKVRLSNRHDIFAHIPGEGHNSQEHSIVLVRGGRVKDSPGVKSHRIRGVKDLLGIPDRRKGRSKYGAERPKSK

SEQ ID NO: 399 - protein, 156 aa, Pisum sativum
MQIFVKTLTGKTITLEVESSDTIDNVKAKIQDKEGIPPDQQRLIFAGKQLEDGRTLADYNIQKESTLHLVLRLRGGAKKRKKKTYTKPKKIKHKKKKVKLAVLQFYKVDDTGKVQRLRKECPNAECGAGTFMANHFDRHYCGKCGLTYVYNKAGGD

SEQ ID NO: 400 - protein, 106 aa, Solanum lycopersicum [sequence omitted]

SEQ ID NO: 401 - protein, 71 aa, Solanum tuberosum
MVPPVQVSPLIKLGRYSALFLGVAYGAKRYNYLKPRAEEERRIAAEEKKKQDELKRIERELAEAQEDSILK

SEQ ID NO: 402 - protein, 78 aa, Oryza sativa
GRGRGQTYTRYQTLELEKEFHFNRYLTRRRRIEMAHALCLSERQIKIWFQNRRMKWKKDNKLKSMSMAAAGGVGYHRP

SEQ ID NO: 403 - protein, 62 aa, Oryza sativa
LKLQKRLAASYLKCGKGKVWLDPNEVSEISMANSRQNIRKLVKDGFIIKKPHKIHSRSRCKK

SEQ ID NO: 404 - protein, 88 aa, Oryza sativa
DDKELKKQLLRKYSGCLGNLRKELCKKRKKDKLPKEARQKLLSWWELHYRWPYPSEMEKIALAESTGLEQKQINNWFINQRKRHWKPS

SEQ ID NO: 405 - protein, 87 aa, Oryza sativa
MEERRKEKGKEGRRGKATGHSVDKFSRSNLPEMEKRKLHLPPGTALFVFVNNTLPQTAQLMGSVYESYKDEGDGFLYLCYSSEKTFG

SEQ ID NO: 406 - protein, 215 aa, Zea mays
MGRGKIEIKRIENSTNRQVTFSKRRAGILKKAREIGVLCDAEVGVVIFSSAGKLSDYCTPKTTSVFPPLSRILEKYQTNSGKILWDEKHKSLSAEIDRVKKENDNMQIELRHMKGEDLNSLQPKELIAIEEALNNGQANLRDKMMDHWRMHKRNEKMLEDEHKMLAFRVHQQEVELSGGIRELELGYHHDDRDFAASMPFTFRVQPSHPNLQQEK

SEQ ID NO: 407 - protein, 66 aa, Zea mays; identical to SEQ ID NO: 175

SEQ ID NO: 408 - protein, 269 aa, Triticum aestivum; identical to SEQ ID NO: 218

SEQ ID NO: 409 - protein, 288 aa, Oryza sativa
MKDRTQELRSAKDSDDEEEVVHVDRDHFMDEFFEQVEEIRGCIEKLSEDVEQVKKQHSAILAAPNPDEKTKQELEDLTTDIKKTANKVRSKLKAIEQSIEQEEGLNRSSADLRIRKTQHSTLSRKFVEVMTEYNATQSKYRDRCKDRIQRQLEITGRTTTNEELEDMLESGKLAIFTDDIKMDSQMTKQALNEIETRHNEIIKLETSIRELHDMFVDMAMLVESQGEMIDRIEYNVEHSVDYVERAVSDTKKAVKYQSKARRKKIMIIICCVVLGVVLASSIGGTLGL

SEQ ID NO: 410 - protein, 166 aa, Oryza sativa; identical to SEQ ID NO: 390

SEQ ID NO: 411 - protein, 85 aa, Sus scrofa; identical to SEQ ID NO: 385

SEQ ID NO: 412 - protein, 60 aa, Triticum aestivum
EKVCADLVKGAKDKHLRVKGPVRIPTKVLHITTRKSPCGEGTNTWDRFEFRIHKRVIDLI

SEQ ID NO: 413 - protein, 203 aa, Oryza sativa
MDYFPMIIALLFVAFQGAPETAVLGAELSPEAESQGETPSPHASWRPRRSKRCSCSSLMDKECVYFCHLDIIWVNTPEHIVPYGLGSPSRSRRSLKDLFPAKAADRRDRCQCASQKDKKCWSFCQAGKEIGRDQDTMEKRWDNQKKGTDCSKLGEKCIHRQLVMGRKIRRLEAISNSIKTSFHIAKLKAELYRDKKVTHNRTH

SEQ ID NO: 414 - protein, 156 aa, Oryza sativa; identical to SEQ ID NO: 399

SEQ ID NO: 415 - protein, 160 aa, Oryza sativa
FNEEGSLYILKGDRTIEFDGEFAADVLVEFLLDLIEDPVEIINSKLEVQAFERIEDHIKLIGFFKSEDSEYYKAFEEAAEHFQPYIKFFATFDKGVAKKLSLKMNEVDFYEPFMEEPIVIPDKPYTEEEIVEFVKEHQRPTLRRLRPEDMFETWEDNLNG

SEQ ID NO: 416 - protein, 44 aa, Oryza sativa
MSDKPDMAEIEKFDKSKLKKTETQEKNPLPSKETIEQEKQAGES

SEQ ID NO: 417 - protein, 119 aa, Salmo salar; identical to SEQ ID NO: 147

SEQ ID NO: 418 - protein, 96 aa, Glycine max
LAGSKHKEEKADLDPSNPVANWIHARSTRKKRCPYTKYQTLELEKEFLFNMYLTRDRRYEVARVLNLTERQVKIWFQNRRMKMKKMNKEKTDKEQS

SEQ ID NO: 419 - protein, 129 aa, Glycine max
MAQNKTIAVALLLATLVAVMGKEPETLEEALRAGCKEECSEQKKKAPIDEKQREDFCFIKTKSIFEAHKGVKDLKADRFIDFCNNECNAVYKEDPATSKKCAESCEADAKEAEVFLDKVVAYMQTTKQA

SEQ ID NO: 420 - protein, 128 aa, Salmo salar; identical to SEQ ID NO: 331

SEQ ID NO: 421 - protein, 194 aa, Sus scrofa
MAAEDVAATGADPSELEGGGLLHEIFTSPLNLLLLGLCIFLLYKIVRGDQPAASDSDDDEPPPLPRLKRRDFTPAELRRFDGVQDPRILMAINGKVFDVTKGRKFYGPEGPYGVFAGRDASRGLATFCLDKEALKDEYDDLSDLTPAQQETLNDWDSQFTFKYHHVGKLLKEGEEPTVYSDEEEPKDESARKND

SEQ ID NO: 422 - protein, 355 aa, Sus scrofa
MASRQGPLCGLAPCCLWLLGVILLMNASARPANHSSARERAGNREENEILPPDHLNGVKLEMDGHLNKDFHQEVFLGKDMDDFEEDAEPRKSRRKLMVIFSKVDLNTDRRISAKEMQKWIMQKTAEHFQEAVAESRAHFRAVDPDGDGHVSWDEYKVKFLATKGHNEREVAEKIKNKWDLNIDEETQEVLENLKDRWYQADNPPPDLLLTESEFLSFLHPEHSRGMLQFMVKEIIRDLDQDGDKKLSLSEFISLPVGTVENQQGQDVDDGWVRDRKREFEELIDANHDGIVTMAELEDYMDPMNEFSALNEAKQMIAIADENQNHYLEPEEVLKYSEFFTGSKLVDYARSVHEEF

SEQ ID NO: 423 - protein, 284 aa, Oryza sativa
MAGEKAEKPGTKEKKPEAKKADAGGKVKKAKKVKKGKPHCSRNPVLVRGIGRYSRSAMYSRKALYKRKYSAAKSKVEKKKKVRVLATVTKPVGGDKNGGTRVVKLRKMPRYYPTEDVPRKLLSHGKKPFSKHVRKLRASITPGTILIILTGRHRGKRVIFLKQLSSGLLLVTGPLSLNRVPLRRTHQKFVIATSTKIDISGVKIPEHLTDAYFKKKKLRKPRHQEGEIFDTEKEKYEISEQRKVDQKAVDSQILRRIKAVPQLQGYLRSVFALTNGIYPHKLVF

SEQ ID NO: 424 - protein, 259 aa, Oryza sativa
MADSREENVYMAKLAEQAERYEEMVEFMEKVAKVDVEELTVEERNLLSVAYKNVIGARRASWRIISSIEQKEESRGNEDHVSSIKEYRVKIEAELSKICDGILSLLESHLVPSASTAESKVFYLKMKGDYHRYLAEFKTGARERKEAAENTLLAYKSAQDIALAELTPTHPIRLGLALNFSVFYYEILNSPDRACNLAKQAFDDAIAELDTLGEESYKDSTLIMQLLRDNLTLWTSDTTDDAEDEIREGSKQESGDGQQ

SEQ ID NO: 425 - protein, 85 aa, Sus scrofa; identical to SEQ ID NO: 395

SEQ ID NO: 426 - protein, 95 aa, Oryza sativa
MSKDSKMRATINQKLTEMGERERLKELLRAKLTECGWRDQLKAHCKDVIKEKGLEHVTVEDLVVEITPKGRVLVPDSVKKELLQRIRAFLAQHAT

SEQ ID NO: 427 - protein, 271 aa, Oryza sativa
MADDNQNEVKDEVVADIAPFDPTKKKKKKEVVIQDTTDDSVGKLAEKAEACTASEGQESTFAGLKKKKKKPIETSILNEESGDAVEDLNERTGEDEEGEGIVLETPSYPWEGSDRDYTYEELLDRVFTILRENNPDLAGDRRRTVMRPPQVLREGTKKAVFVNFMDLCKTMHRQPDHVMAFLLAELGTSGSLDGQQRLVVKGRFAPKNFEGILRRYVNEYVICLGCQSPDTILSKENRLFFLRCEKCGSGRSVAPNKAGFMARVGRRNAGT

SEQ ID NO: 428 - protein, 15 aa, Zea mays
EGKAIGLAKPRMDST

SEQ ID NO: 429 - protein, 143 aa, Oryza sativa
MSEGFDGTENGGGGGGGGVGKEQDRFLPIANIGRIMRRAVPENGKIAKDSKESVQECVSEFISFITSEASDKCLKEKRKTINGDDLIWSMGTLGFEDYVEPLKLYLRLYRETEGDTKGSRASELPVKKDVVLNGDPGSSFEGM

SEQ ID NO: 430 - protein, 184 aa, Sus scrofa
MAHLVWMLGENGEEKSFENPNELLPLSRLEEIGVLYWHLDPKKSESEEELTKIRRERGYSYFDLTEICPDKLENYEEKLKSFYCEHIHADEEIRYCLEGSGYFDVRDKDDKWIRIWIKEGDMIILPAGIYHRFIVDSNNYIKLMRLFIGEPVWTAYNRPQEDHPVRQEYVKNVKGDTGFALAAH

SEQ ID NO: 431 - protein, 32 aa, Oryza sativa
  MOD_RES (3)..(4): Any amino acid
TKXXEAPAPKGLKGNEMLKGIFLEVKKKFETA

SEQ ID NO: 432 - protein, 62 aa, Pisum sativum
PGLAAAIPAPPESQEKKPLKPCCACPETKKARDACIIEKGEEHCGHLIEAHKECMRALGFKI

SEQ ID NO: 433 - protein, 150 aa, Oryza sativa
MAPKAEKKPAAKKPAEEEPAAEKAPAGKKPKAEKRVPAGKSAGKEGGEGKRGRKKGKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 434 - protein, 151 aa, Oryza sativa
MEILGFTVMGGGGSPAWIEVPEKSKSAFWELKRRKVHRYVIFKIDDRREEIVVEKTGAPGESYDDFTASLPADDCRYAVYDLDFVSDDNCRKSKIFFISWSPSVSRIRAKTIYAVSRNQFRHELDGVHFEIQATDPDDMDLEVLRGRANRT

SEQ ID NO: 435 - protein, 125 aa, Oryza sativa [sequence omitted]

SEQ ID NO: 436 - protein, 47 aa, Pisum sativum
KTCENLSGTFKGPCIPDGNCNKHCRNNEHLLSGRCRDDFRCWCTNRC

SEQ ID NO: 437 - protein, 95 aa, Oryza sativa
MADEKPKEGVKTENNDHINLKVAGQDGSVVQFKIKRHTPLSKLMKAYCERQGLSMRQIRFRFDGQPINETDTPAQLEMEDEDTIDVFQQQTGGVY

SEQ ID NO: 438 - protein, 575 aa, Ovis aries; identical to SEQ ID NO: 224

SEQ ID NO: 439 - protein, 311 aa, Sus scrofa
MKRPTSSSRKSKKQGEDLAFSEEGSLPAVTMEQKDEAEMEEVDEEEEEEVDEDMAGGHAAQSPSPSCGLGEKKRRLALEQVRALERSFDTDNKLDPDRKARIARDLGLQPRQVAVWFQNRRARWKTKQLERDFAALRARHDALRADCDALRRDKDALAAEIRELREKLPTKPADTAASVKVEAGNDAAAGAAAATVCKDGSSDDSDSSVVFNDEASPYSGAAFIGFGPSFLVDDASAATVGCSSSLPALESKWHGPYSDDSCKGGVYGFTEEWLAACSGEMAGNDAAGFFSDEHASNLNFGWCASGNEGWE

SEQ ID NO: 440 - protein, 142 aa, Oryza sativa
MSAPSLPPAWQLYLKDHRISTFKNWPFLEGCACTPERMAAAGFIHCPTENEPDLAQCFFCFKELEGWEPDDDPIEEHKKHSSGCAFLSVKKQFEELTLSEFLKLDKERAKNKIAKETNNKQKEFEETAKKVRCAIEQLAASE

SEQ ID NO: 441 - protein, 107 aa, Oryza sativa
MTEKKNSREKKNPREAKVTFEGLVTEALPNGMFRVRLENDTIILGYISGKIRSSSIRILMGDRVKIEISRYDSSKGRIIYRLPHKDSKRTEDSKDTEDLKDTKDSKD

SEQ ID NO: 442 - protein, 339 aa, Oryza sativa
  MOD_RES (290)..(290): Any amino acid
MSTVHEILCKLSLEGDHSTPASAYGSVKAYTNFDAERDALNIETAIKTKGVDEVTIVNILTNRSNEQRQDIAFAYQRRTKKELASALKSALSGHLETVILGLLKTPAQYDASELKASMKGLGTDEDSLIEIICSRTNQELQEINRVYKEMYKTDLEKDIISDTSGDFRKLMVALAKGRRAEDGSVIDYELIDQDARDLYDAGVKRKGTDVPKWISIMTERSVCHLQKVFERYKSYSPYDMLESIKKEVKGDLENAFLNLVQCIQNKPLYFADRLYDSMKGKGTRDKVLIXIMVSRSEVDMLKIRSEFKRKYGKSLYNYIQQDTKGDYQKALLYLCGGDD

SEQ ID NO: 443 - protein, 200 aa, Oryza sativa
MEALSGRVGVKCGRWNPTAEQVKVLTELFRAGLRTPSTEQIQRISTHLSAFGKVESKNVFYWFQNHKARERHHHKKRRRGASSPDSGSNDDDGRAAAHEGDADLVLQPPESKREARSYGHHHRLMTCYVRDVVETEAMWERPTREVETLELFPLKSYDLEVDKVRYVRGGGGEQCREISFFDVAAGRDPPLELRLCSFGL

SEQ ID NO: 444 - protein, 85 aa, Oryza sativa
ELKYQLLKKYSGYLSSLRQEFSKKKKKGKLPKEARQKLLHWWELHYKWPYPSETEKIALAEATGLDQKQINNWFINQRKRHWKPS

SEQ ID NO: 445 - protein, 223 aa, Oryza sativa
MAIYKVALLLLFGMILLASDFEHAKACTKECDTRIDFGICPLLETKRVEGLCTNCCAGKKGCKYFSKDGTYICDGESEWVSEKNNNLKKACTKECDTRIDFGICPLLETKRVEGLCTNCCAGKKGCKYFSKDGTYICDGESEWVSEKDNNLEKDCTKECDTRIDFGICPLLETKRVKGLCTNCCAGKKGCKYFSADGTYICDGESEWVSEGENDLQKSNVAIS

SEQ ID NO: 446 - protein, 168 aa, Ovis aries
MQTPQFLQQRRKFAAAFLAFIFLLAVVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNADCQKTVTISKPCGKVTKPKPQAESKKKKKEGKKQEKMLD

SEQ ID NO: 447 - protein, 142 aa, Oryza sativa
MAPKAGKKPAEKKPVEEKKAEEVPAEKKPKAGKKLPKDAGADKKKKKSKKSVETYKIYIFKVLKQVHPDIGISSKSMGIMNSFINDIFEKLAQESSRLARINKKPTITSREIQTAVRLVLPGELAKHAVSEGTKAVTKFTSN

SEQ ID NO: 448 - protein, 380 aa, Sus scrofa
MGIKGLTKLLADNAPKAMKEQKFESYFGRRIAVDASMSIYQFLIVVGRTGMETLTNEAGEVTSHLQGMFNRTIRLLEAGIKPVYVFDGKPPDLKKQELAKRYSKREDATKELTEAVEEGDKDAIEKFSKRTVKVTKQHNEECKRLLRLMGVPVVEAPCEAEAECAALCINDMVYAVASEDMDSLTFGAPRFLRHLMDPSSKKIPVMEFEVAKVLEELELTMDQFIDLCILSGCDYCDSIKGIGGQTALKLIRQHGSIESILENINKDRYQIPEDWPYQEARRLFKEPNVTLDIPELKWNAPDEEGLVQFLVKENGFNQDRVTKAIEKIKFAKNKSSQGRLESFFKPVVSTSVPLKRKDTSEKPTKAVANKKTKGAGGKKK

SEQ ID NO: 449 - protein, 346 aa, Sus scrofa
MAMVSEFLKQAWFIDNEEQEYIKTVKGSKGGPGSAVSPYPTFNPSSDVEASHKAITVKGVDEATIIEIHTKRTNAQRQQIKAAYLQEKGKPLDEALKKALTGHLEEVALALLKTPAQFDADELRAAMKGLGTDEDTLNEILASRTNREIREINRVYKEELKRDLAKDITSDTSGDYQKALLSLAKGDRSEDLAINDDLADTDARALYEAGERRKGTDLNVFITILTTRSYLHLRRVFQKYSKYSKHDMNKVLDLELKGDIENCLTVVVKCATSKPMFFAEKLHQAMKGNGTRHKTLIRIMVSRSEIDMNDIKACYQKLYGISLCQAILDETKGDYEKILVALCGGD

SEQ ID NO: 450 - protein, 220 aa, Oryza sativa
MGISRDSMHKRRATGGKQKAWRKKRKYELGRQPANTKLSSNKTVRRVRVRGGNVKWRALRLDTGNYSWGSEAVTRKTRILDVVYNASNNELVRTQTLVKSAIVQVDAAPFKQWYLTHYGVDIGRKKKAPAAKKDAEGQDAEATTEEAKKSNHVVRKLEKRQQGRTLDAHIEEQFGSGRLLACISSRPGQCGRADGYILEGKELEFYMKKLQRKKGKGASA

SEQ ID NO: 451 - protein, 367 aa, Oryza sativa
MATAAASDLESKAKAAFVDDDFELAAELYTQAIEASPATAELYADRAQAHIKLGNYTEAVADANKAIELDPSMHKAYLRKGAACIRLEEYQTAKAALELGYSFASGDSRFTRLMKECDERIAEELSEVPVKKAEDGAAAPSVASFVEEKDDAANMDNTPPMVEVKPKYRHDFYNSATEVVLTIFAKGVPAENVVVDFGEQMLSVSIEVPGEEPYHFQPRLFSKIIPEKSRYQVLSTKVEIRLAKAEQITWTSLDYDKKPKAVPQKIIPPAESAQRPSYPSSKSKKDWDKLEAEVKKEEKEEKLEGDAALNKFFRDIYSDADEDMRRAMMKSFVESNGTVLSTNWKDVGSKKVEGSPPDGMELKKWEY

SEQ ID NO: 452 - protein, 87 aa, Sus scrofa
MVKNSVISVISQEEKKGSVEFQVFNFTNKIRRLTSHLELHKKDYLSQRGLKKILGKRQRLLAYLAKKNRVRYKELINRLDIRETKTR

SEQ ID NO: 453 - protein, 137 aa, Oryza sativa
MAPKAEKKPAEKKPTEEKAEKKPRAEKRVPGKEGGEKKGKKKAKKSVETYKIYIFKVLKQVHPDIGISSKAMSIMNSFINDIFEKLAAEAAKLARYNKKPTITSREIQTSVRLVLPGELAKHAVSEGTKAVTKFTSS

SEQ ID NO: 454 - protein, 135 aa, Oryza sativa
MAPKAAEKKPVEKTPAVKKPKAEKKVPTSKEGGEKKGKKKSKKSMETYKIYIFKVLKQVHPDIGISSKAMSITNSFINDIFEKLAGESAKLARYNKKPTITSREIQTSVRLVLPGELAKHAVSEGTKAVTKFTSA

SEQ ID NO: 455 - protein, 125 aa, Glycine max; identical to SEQ ID NO: 263

SEQ ID NO: 456 - protein, 128 aa, Zea mays
MAPVKKLVAKGGKKKKQVLKFTLDCTHPVEDGIMDAANFEQFLQERIKVNGKAGNLGGGVVTIERSKSKITVTSEVPFSKRYLKYLTKKYLKKNNLRDWLRVVANSKESYELRYFQINQDEEEEEDED

SEQ ID NO: 457 - protein, 294 aa, Oryza sativa
MTKTYRISSGLLREAVKKITIARDSAFFVDKEILSKSSELKNSLINPCHNVVREFVRESRDCDSDDYKREYRLNDYRLELTQPPSNISRGVIVVKTVRRWELINQKYNADLWIPPAKKGVVITPDIIDKLYLFWDNFLGSYEKEGINRKQNTDPVSKGKVFDLLASRSSNNTNQTPEELREIQTQIEHLTIHFDEGSVHESAGQLKGKFFNKDRQSARDYLLDKLKDDKDKDIVRGMGTYTLECVAIHVLSKLFNVFSLEKTSVLAAALISELDITAKTEYNNALLAKMQREKE

SEQ ID NO: 458 - protein, 145 aa, Oryza sativa
MAFVRSRANASSGIGVAAECKQTFLELQRKKSHRYVIFKIDDKCKEVVVEKTGSSTESFDDFMDSLPESDCRYAIYDFDFVTEENCQKSKIFFVAWSPSVSRIRAKMLYATSKERFRRELDGVHYEIQATDPSELDIELLRERAH

SEQ ID NO: 459 - protein, 153 aa, Solanum lycopersicum
MAPKAEKKPAAKKPAEEEPAAEKAEKALAGKKPKAEKRLPAGKAEKSSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 460 - protein, 153 aa, Sus scrofa
MQIFVKTLTGKTITLEVESSDTIDNVKAKIQDKEGIPPDQQRLIFAGKQLEDGRTLADYNIQKESTLHLVLRLRGGTMIKVKTLTGKEIEIDIEPTDTIDRIKERVEEKEGIPPVQQRLIYAGKQLADDKTAKDYNIEGGSVLHLVLALRGGY

SEQ ID NO: 461 - protein, 153 aa, Sus scrofa
MAPKAEKKPAAKKPAEEEPAAEKAEKAPAGKKPKAEKRLPAGKAEKGSGEGKKAGRKKAKKSVETYKIYIFKVLKQVHPDIGISSKAMSIMNSFINDIFEKLAGESAKLARYNKKPTITSREIQTSVRLVLPGELAKHAVSEGTKAVTKFTSA

SEQ ID NO: 462 - protein, 327 aa, Glycine max
MEEEFKDKGLPPTLLHLIPDGREWKVKEADGEGSRNTNLDADEDKELELKLGLPGVQQEERAADSREKIQQQQRESSSEPSIGCFPTHSKPTTSIGTTGAKRGFFAIVGATLEGYNQSHRDTEECGKELTLGDENMAGERKKGCCPSPPCSAAAHSSNPQGRGAIPPVVGWPPIRSFRRNLTNGSSFKQSPERQNDEADDKAKPICKKRPLVKINMDGIPIGRKVDLQIYDSYQKLSSAVEELFRGFLEAQKDLSCAESGEQGAEDKIFSGLLDGTGVYTLVYEDNDGDRMLAGDIPWKVFVSTVKRLRVMRRSELPHDMIGADPVK

SEQ ID NO: 463 - protein, 315 aa, Pisum sativum
MEIRPLLMCFALCVVYATSKPTEKKERIHHDAPLSSREHDDAQGFDYDHDAFLGQKEAKSFDDLSPEESKRRLGVIVEKIDGDSDGFVTEVELRAWIKKAQKKYIYENVDRQWKDFDVNNDGMISWEEYRNVTYGTYLDDPEPDDGYNYQHMMARDERRFKMADQNRDQIANKEEFTAFLHPEEYDHMKDIVVLETMEDIDKNGDGFIDLNEYIGDMYNHEDEMEEPDWVATEREQFSEFRDKNKDGKMDREETMDWILPSDYDHAEAEAKHLVYESDSNKDGKLSKEEILNKYDLFVGSQATDFGEALVRHDEF

SEQ ID NO: 464 - protein, 178 aa, Bos taurus
MKCLLLALALTCGAQALIVTQTMKGLDIQKVAGTWYSLAMAASDISLLDAQSAPLRVYVEELKPTPEGDLEILLQKWENGECAQKKIIAEKTKIPAVFKIDALNENKVLVLDTDYKKYLLFCMENSAEPEQSLACQCLVRTPEVDDEALEKFDKALKALPMHIRLSFNPTQLEEQCHI

SEQ ID NO: 465 - protein, 214 aa, Bos taurus
MKLLILTCLVAVALARPKHPIKHQGLPQEVLNENLLRFFVAPFPEVFGKEKVNELSKDIGSESTEDQAMEDIKQMEAESISSSEEIVPNSVEQKHIQKEDVPSERYLGYLEQLLRLKKYKVPQLEIVPNSAEERLHSMKEGIHAQQKEPMIGVNQELAYFYPELFRQFYQLDAYPSGAWYYVPLGTQYTDAPSFSDIPNPIGSENSEKTTMPLW

SEQ ID NO: 466 - protein, 150 aa, Homarus americanus
MDSLDEEQIGALQKAFDSFDTDSKGFITPETVGVILRMMGVKISEKNLQEVIAETDEDGSGELEFEEFVELAAKFLIEEDEEALKTELREAFRVYDKEGNGYITTDVLKEILRELDNRLTEEDLDSIIEEVDEDGSGTLDFNEFMEMMNG

SEQ ID NO: 467 - protein, 262 aa, Gallus gallus
MEMKKRLTLELRNKKPGEVKELVLDNCRSDDGKIVGLSSDFENLEFLSMINVNLLSISNLPKLNKLRKLELSDNRISGGLEVLAERTPNLTHLNLSGNKIKDINTLEPLKKLPNLHSLDLFNCEVTMLINYRESVFTLLPQLTYLDGFDADEQEAPDSDPEADGDGLEDEYENGEGEEEEDDDEEDDLDEEVIDEEDDEDDDLEGEEEEDGVDDEEEDEEEDGEDEEDDEADDDLPRGEKRKRNLEDEGEEDPEDEEDDEDD

SEQ ID NO: 468 - protein, 152 aa, Mizuhopecten yessoensis
TEEFRASEKQILDAKQAFCNVDKKKEGTVSCKDLGAIFKSLGLLVKDDKIKDWSDEMDEEATGRLNCDAWIQLFERKLKEDLDERELKEAFRVLDKEKKGVIKVDVLRWILSSLGDELTEEEIENMIAETDTDGSGTVDYEEFKCLMMSSDA

SEQ ID NO: 469 - protein, 160 aa, Oryctolagus cuniculus
MTDQQAEARSYLSEEMIAEFKAAFDMFDADGGGDISVKELGTVMRMLGQTPTKEELDAIIEEVDEDGSGTIDFEEFLVMMVRQMKEDAKGKSEEELAECFRIFDRNADGYIDAEELAEIFRASGEHVTDEEIESLMKDGDKNNDGRIDFDEFLKMMEGVQ

SEQ ID NO: 470 - protein, 161 aa, Sus scrofa; identical to SEQ ID NO: 62

SEQ ID NO: 471 - protein, 161 aa, Bos taurus; identical to SEQ ID NO: 62

SEQ ID NO: 472 - protein, 150 aa, Crangon crangon
MDSLEPDQIDALKKAFDSFDTENQGFITADTVATILRMMGVKISDKNLAEVIAETDEDGSGQLEFEEFVDLSSKFLIEEDEEALKAELREAFRIYDKEGQGFITTDVLKEILTEIDNKLTPEDLDGIIEEVDEDGSGTLDFDEFMEMMSG

SEQ ID NO: 473 - protein, 151 aa, Bos taurus
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 474 - protein, 151 aa, Gallus gallus
MCDFSEEQTAEFKEAFQLFDRTGDGKILYSQCGDVMRALGQNPTNAEVMKVLGNPKSDEMNLKTLKFEQFLPMMQTIAKNKDQGCFEDYVEGLRVFDKEGNGTVMGAEIRHVLVTLGEKMTEEEVEQLVAGHEDSNGCINYEELVRMVLSG

SEQ ID NO: 475 - protein, 150 aa, Gallus gallus
MSFSPDEINDFKEAFLLFDRTGDAKITLSQVGDIVRALGQNPTNAEINKILGNPSKEEMNAKKITFEEFLPMLQAAANNKDQGTFEDFVEGLRVFDKEGNGTVMGAELRHVLATLGEKMTEEEVEELMKGQEDSNGCINYEAFVKHIMSV

SEQ ID NO: 476 - protein, 445 aa, Zea mays
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRMMLTFSVFPSPKVSDTVVEPYNATLSVHQLVENADECMVLDNEALYDICFRTLKLATPTFGDLNHLISATMSGVTCCLRFPGQLNSDLRKLAVNLIPFPRLHFFMVGFAPLTSRGSQQYRALTVPELTQQMWDSKNMMCAADPRHGRYLTASAMFRGKMSTKEVDEQMLNVQNKNSSYFVEWIPNNVKSSVCDIPPIGLKMSSTFVGNSTSIQEMFRRVSEQFTAMFRRKAFLHWYTGEGMDEMEFTEAESNMNDLVAEYQQYQDATAEDEEYEEEEEEEEET

SEQ ID NO: 477 - protein, 159 aa, Sus scrofa; identical to SEQ ID NO: 50

SEQ ID NO: 478 - protein, 162 aa, Meleagris gallopavo; identical to SEQ ID NO: 45

SEQ ID NO: 479 - protein, 73 aa, Lactococcus lactis
MAVFEKVQDIIVDELGKEKEEVTLETSFEELDADSLDLFQIINDIEDEFDVEVDTEADMKTVADLVKYVENNK

SEQ ID NO: 480 - protein, 81 aa, Thermosynechococcus elongatus
MNQSEILEKVKAIVADQLSVDPEKVVPEASFAEDLNADSLDSVELIMALEEEFGVEIPDEEAEKLKTVQDVLDFINNKVAA

SEQ ID NO: 481 - protein, 80 aa, Lactobacillus acidophilus
MSEEEIFNKIKDLIADNFEVDKDSITENTNFMNDLDADSIDLVEFILQLEDEFGAEIPDDEAEKIKTVGDAVSYIKSHQG

SEQ ID NO: 482 - protein, 81 aa, Thermotoga maritima
MASREEIFSKVKSIISEKLGVDESQVTEEAKLIDDLGADSLDLVDLVMDFESEFGVKVDDADLEKISTVGDIVSYIEKKLG

SEQ ID NO: 483 - protein, 80 aa, Lactobacillus johnsonii
MTEEEIFNKIADMISERFSIDRDKITKDLNFQNDLDADSIDFVELVMDLEDTFGAEIPDDDAEKLQTVGEAVEYIKSHQN

SEQ ID NO: 484 - protein, 154 aa, Oryza sativa; identical to SEQ ID NO: 47

SEQ ID NO: 485 - protein, 149 aa, Zea mays; identical to SEQ ID NO: 33

SEQ ID NO: 486 - protein, 147 aa, Saccharomyces cerevisiae
MSSNLTEEQIAEFKEAFALFDKDNNGSISSSELATVMRSLGLSPSEAEVNDLMNEIDVDGNHQIEFSEFLALMSRQLKSNDSEQELLEAFKVFDKNGDGLISAAELKHVLTSIGEKLTDAEVDDMLREVSDGSGEINIQQFAALLSK

SEQ ID NO: 487 - protein, 149 aa, Capsicum annuum; identical to SEQ ID NO: 26

SEQ ID NO: 488 - protein, 417 aa, Bos taurus
MLLPVPLLLGLLGLAAADPTVYFKEQFLDGDGWTERWIESKHKPDFGKFVLSSGKFYGDQEKDKGLQTSQDARFYALSARFEPFSNKGQTLVVQFTVKHEQNIDCGGGYVKLFPAGLDQTDMHGDSEYNIMFGPDICGPGTKKVHVIFNYKGKNVLINKDIRCKDDEFTHLYTLIVRPNNTYEVKIDNSQVESGSLEDDWDFLPPKKIKDPDAAKPEDWDDRAKIDDPTDSKPEDWDKPEHIPDPDAKKPEDWDEEMDGEWEPPVIQNPEYKGEWKPRQIDNPEYKGIWIHPEIDNPEYSPDSNIYAYENFAVLGLDLWQVKSGTIFDNFLITNDEAYAEEFGNETWGVTKAAEKQMKDKQDEEQRLHEEEEEKKGKEEEEADKDDDEDKDEDEEDEDEKEEEEEEDAAAGQAKDEL

SEQ ID NO: 489 - protein, 420 aa, Zea mays; identical to SEQ ID NO: 11

SEQ ID NO: 490 - protein, 162 aa, Ovis orientalis
IIVTQTMKGLDIQKVAGTWHSLAMAASDISLLDAQSAPLRVYVEELKPTPEGNLEILLQKWENGECAQKKIIAEKTKIPAVFKIDALNENKVLVLDTDYKKYLLFCMENSAEPEQSLACQCLVRTPEVDNEALEKFDKALKALPMHIRLAFNPTQLEGQCHV

SEQ ID NO: 491 - protein, 386 aa, Gallus gallus
MGSIGAASMEFCFDVFKELKVHHANENIFYCPIAIMSALAMVYLGAKDSTRTQINKVVRFDKLPGFGDSIEAQCGTSVNVHSSLRDILNQITKPNDVYSFSLASRLYAEERYPILPEYLQCVKELYRGGLEPINFQTAADQARELINSWVESQTNGIIRNVLQPSSVDSQTAMVLVNAIVFKGLWEKAFKDEDTQAMPFRVTEQESKPVQMMYQIGLFRVASMASEKMKILELPFASGTMSMLVLLPDEVSGLEQLESIINFEKLTEWTSSNVMEERKIKVYLPRMKMEEKYNLTSVLMAMGITDVFSSSANLSGISSAESLKISQAVHAAHAEINEAGREVVGSAEAGVDAASVSEEFRADHPFLFCIKHIATNAVLFFGRCVSP

SEQ ID NO: 492 - protein, 147 aa, Saccharomyces cerevisiae; identical to SEQ ID NO: 486

SEQ ID NO: 493 - protein, 73 aa, Saccharomyces cerevisiae
LVLGALLDTSHKFRNLDKDLCEKCAKCISMIGVLDVTKHEFKRTTYSENEVYDLNDSVQTIKFLIWVINDILV

SEQ ID NO: 494 - protein, 20 aa, Artificial Sequence
  Description of Artificial Sequence: Synthetic peptide
MGSSHHHHHHSSGLVPRGSH

SEQ ID NO: 495 - protein, 11 aa, Artificial Sequence
  Description of Artificial Sequence: Synthetic peptide
MGSHHHHHHHH

SEQ ID NO: 496 - protein, 4 aa, Saccharomyces cerevisiae
LALA

SEQ ID NO: 497 - protein, 4 aa, Saccharomyces cerevisiae
LLLD

SEQ ID NO: 498 - protein, 4 aa, Saccharomyces cerevisiae
PSEA

SEQ ID NO: 499 - protein, 4 aa, Saccharomyces cerevisiae
IAEF

SEQ ID NO: 500 - protein, 4 aa, Saccharomyces cerevisiae
IQQF

SEQ ID NO: 501 - protein, 4 aa, Saccharomyces cerevisiae
YDKL

SEQ ID NO: 502 - protein, 4 aa, Saccharomyces cerevisiae
AEFK

SEQ ID NO: 503 - protein, 5 aa, Saccharomyces cerevisiae
SNLTE

SEQ ID NO: 504 - protein, 4 aa, Saccharomyces cerevisiae
LKHV

SEQ ID NO: 505 - protein, 5 aa, Saccharomyces cerevisiae
ELLEA

SEQ ID NO: 506 - protein, 5 aa, Saccharomyces cerevisiae
SSSEL

SEQ ID NO: 507 - protein, 5 aa, Saccharomyces cerevisiae
EELAL

SEQ ID NO: 508 - protein, 4 aa, Saccharomyces cerevisiae
FKVF

SEQ ID NO: 509 - protein, 5 aa, Saccharomyces cerevisiae
DDLLL

SEQ ID NO: 510 - protein, 5 aa, Saccharomyces cerevisiae
AELKH

SEQ ID NO: 511 - protein, 5 aa, Saccharomyces cerevisiae
LAYDK

SEQ ID NO: 512 - protein, 5 aa, Saccharomyces cerevisiae
LKHVL

SEQ ID NO: 513 - protein, 5 aa, Saccharomyces cerevisiae
TKTRL

SEQ ID NO: 514 - protein, 5 aa, Saccharomyces cerevisiae
FKEAF

SEQ ID NO: 515 - protein, 5 aa, Saccharomyces cerevisiae
DLDHQ

SEQ ID NO: 516 - protein, 7 aa, Saccharomyces cerevisiae
NGSISSS

SEQ ID NO: 517 - protein, 6 aa, Saccharomyces cerevisiae
GTLENL

SEQ ID NO: 518 - protein, 7 aa, Saccharomyces cerevisiae
SLGLSPS

SEQ ID NO: 519 - protein, 6 aa, Saccharomyces cerevisiae
EKLTDA

SEQ ID NO: 520 - protein, 6 aa, Saccharomyces cerevisiae
GEKLTD

SEQ ID NO: 521 - protein, 6 aa, Saccharomyces cerevisiae
AEVDDM

SEQ ID NO: 522 - protein, 6 aa, Saccharomyces cerevisiae
ELATVM

SEQ ID NO: 523 - protein, 6 aa, Saccharomyces cerevisiae
LDDLLL

SEQ ID NO: 524 - protein, 7 aa, Saccharomyces cerevisiae
GSGEINI

SEQ ID NO: 525 - protein, 6 aa, Saccharomyces cerevisiae
LDLDHQ

SEQ ID NO: 526 - protein, 7 aa, Saccharomyces cerevisiae
RSLGLSP

SEQ ID NO: 527 - protein, 6 aa, Saccharomyces cerevisiae
DLKKKL

SEQ ID NO: 528 - protein, 6 aa, Saccharomyces cerevisiae
ELKHVL

SEQ ID NO: 529 - protein, 6 aa, Saccharomyces cerevisiae
KTKTRL

SEQ ID NO: 530 - protein, 7 aa, Saccharomyces cerevisiae
KLTDAEV

SEQ ID NO: 531 - protein, 6 aa, Saccharomyces cerevisiae
SQRLEE

SEQ ID NO: 532 - protein, 6 aa, Saccharomyces cerevisiae
FKVFDK

SEQ ID NO: 533 - protein, 7 aa, Saccharomyces cerevisiae
AEVDDML

SEQ ID NO: 534 - protein, 7 aa, Saccharomyces cerevisiae
AEVDDML

SEQ ID NO: 535 - protein, 7 aa, Saccharomyces cerevisiae
QQELDDL

SEQ ID NO: 536 - protein, 7 aa, Saccharomyces cerevisiae
DAEVDDM

SEQ ID NO: 537 - protein, 7 aa, Saccharomyces cerevisiae
LEKTKTR

SEQ ID NO: 538 - protein, 7 aa, Saccharomyces cerevisiae
AELKHVL

SEQ ID NO: 539 - protein, 7 aa, Saccharomyces cerevisiae
LEKTKTR

SEQ ID NO: 540 - protein, 8 aa, Saccharomyces cerevisiae
HVLTSIGE

SEQ ID NO: 541 - protein, 8 aa, Saccharomyces cerevisiae
GTLENLEE

SEQ ID NO: 542 - protein, 8 aa, Saccharomyces cerevisiae
SIGEKLTD

SEQ ID NO: 543 - protein, 8 aa, Saccharomyces cerevisiae
QQELDDLL

SEQ ID NO: 544 - protein, 9 aa, Saccharomyces cerevisiae
RSLGLSPSE

SEQ ID NO: 545 - protein, 10 aa, Saccharomyces cerevisiae
KLEKTKTRLQ

SEQ ID NO: 546 - protein, 9 aa, Saccharomyces cerevisiae
VLTSIGEKL

SEQ ID NO: 547 - protein, 11 aa, Saccharomyces cerevisiae
SRQLKSNDSEQ

SEQ ID NO: 548 - protein, 9 aa, Saccharomyces cerevisiae
TSIGEKLTD

SEQ ID NO: 549 - protein, 11 aa, Saccharomyces cerevisiae
EKTKTRLQQEL

SEQ ID NO: 550 - protein, 9 aa, Saccharomyces cerevisiae
HVLTSIGEK

SEQ ID NO: 551 - protein, 11 aa, Saccharomyces cerevisiae
YDKLEKTKTRL

SEQ ID NO: 552 - protein, 9 aa, Saccharomyces cerevisiae
AELKHVLTS

SEQ ID NO: 553 - protein, 13 aa, Saccharomyces cerevisiae
LAYDKLEKTKTRL

SEQ ID NO: 554 - protein, 10 aa, Saccharomyces cerevisiae
RSLGLSPSEA

SEQ ID NO: 555 - protein, 13 aa, Saccharomyces cerevisiae
EELKKKLLKDLEL

SEQ ID NO: 556 - protein, 10 aa, Saccharomyces cerevisiae
SSNLTEEQIA

SEQ ID NO: 557 - protein, 14 aa, Saccharomyces cerevisiae
EELKKKLLKDLELL

SEQ ID NO: 558 - protein, 11 aa, Saccharomyces cerevisiae
RSLGLSPSEAE

SEQ ID NO: 559 - protein, 16 aa, Saccharomyces cerevisiae
AELKHVLTSIGEKLTD

SEQ ID NO: 560 - protein, 13 aa, Saccharomyces cerevisiae
KVFDKNGDGLISA

SEQ ID NO: 561 - protein, 15 aa, Saccharomyces cerevisiae
MGSHHHHHHHHSSNL

SEQ ID NO: 562 - protein, 14 aa, Saccharomyces cerevisiae
FDKDNNGSISSSEL

SEQ ID NO: 563 - protein, 16 aa, Saccharomyces cerevisiae
LREVSDGSGEINIQQF

SEQ ID NO: 564 - protein, 14 aa, Saccharomyces cerevisiae
REVSDGSGEINIQQ

SEQ ID NO: 565 - protein, 17 aa, Saccharomyces cerevisiae
AAELKHVLTSIGEKLTD

SEQ ID NO: 566 - protein, 13 aa, Saccharomyces cerevisiae
DVDGNHQIEFSEF

SEQ ID NO: 567 - protein, 18 aa, Saccharomyces cerevisiae
AELKHVLTSIGEKLTDAE

SEQ ID NO: 568 - protein, 15 aa, Saccharomyces cerevisiae
LREVSDGSGEINIQQ

SEQ ID NO: 569 - protein, 16 aa, Saccharomyces cerevisiae
AYDKLEKTKTRLQQEL

SEQ ID NO: 570 - protein, 15 aa, Saccharomyces cerevisiae
REVSDGSGEINIQQF

SEQ ID NO: 571 - protein, 19 aa, Saccharomyces cerevisiae
AAELKHVLTSIGEKLTDAE

SEQ ID NO: 572 - protein, 21 aa, Saccharomyces cerevisiae
LREVSDGSGEINIQQFAALLS

SEQ ID NO: 573 - protein, 17 aa, Saccharomyces cerevisiae
LENLEELKKKLLKDLEL

SEQ ID NO: 574 - protein, 17 aa, Saccharomyces cerevisiae
KLEKTKTRLQQELDDLL

SEQ ID NO: 575 - protein, 18 aa, Saccharomyces cerevisiae
DKLEKTKTRLQQELDDLL

SEQ ID NO: 576 - protein, 20 aa, Saccharomyces cerevisiae
LAYDKLEKTKTRLQQELDDL

SEQ ID NO: 577 - protein, 22 aa, Saccharomyces cerevisiae
LALAYDKLEKTKTRLQQELDDL

SEQ ID NO: 578 - protein, 4 aa, Saccharomyces cerevisiae
INDI

SEQ ID NO: 579 - protein, 4 aa, Saccharomyces cerevisiae
HLVL

SEQ ID NO: 580 - protein, 4 aa, Saccharomyces cerevisiae
IGVL

SEQ ID NO: 581 - protein, 4 aa, Saccharomyces cerevisiae
TIKF

SEQ ID NO: 582 - protein, 4 aa, Saccharomyces cerevisiae
TIKF

SEQ ID NO: 583 - protein, 5 aa, Saccharomyces cerevisiae
IGVLD

SEQ ID NO: 584 - protein, 4 aa, Saccharomyces cerevisiae
TIKF

SEQ ID NO: 585 - protein, 4 aa, Saccharomyces cerevisiae
RNLD

SEQ ID NO: 586 - protein, 5 aa, Saccharomyces cerevisiae
EVYDL

SEQ ID NO: 587 - protein, 6 aa, Saccharomyces cerevisiae
IGVLDV

SEQ ID NO: 588 - protein, 6 aa, Saccharomyces cerevisiae
LNDSVQ

SEQ ID NO: 589 - protein, 5 aa, Saccharomyces cerevisiae
QTIKF

SEQ ID NO: 590 - protein, 6 aa, Saccharomyces cerevisiae
IWVIND

SEQ ID NO: 591 - protein, 6 aa, Saccharomyces cerevisiae
VQTIKF

SEQ ID NO: 592 - protein, 7 aa, Saccharomyces cerevisiae
DLNDSVQ

SEQ ID NO: 593 - protein, 7 aa, Saccharomyces cerevisiae
SVQTIKF

SEQ ID NO: 594 - protein, 7 aa, Saccharomyces cerevisiae
SVQTIKF

SEQ ID NO: 595 - protein, 12 aa, Saccharomyces cerevisiae
KCAKCISMIGVL

SEQ ID NO: 596 - protein, 10 aa, Saccharomyces cerevisiae
HHLVLGALLD

SEQ ID NO: 597 - protein, 12 aa, Saccharomyces cerevisiae
EKCAKCISMIGV

SEQ ID NO: 598 - protein, 9 aa, Saccharomyces cerevisiae
HHHHHHLVL

SEQ ID NO: 599 - protein, 10 aa, Saccharomyces cerevisiae
HEFKRTTYSE

SEQ ID NO: 600 - protein, 11 aa, Saccharomyces cerevisiae
HHHHHHHHLVL

SEQ ID NO: 601 - protein, 11 aa, Saccharomyces cerevisiae
SHKFRNLDKDL

SEQ ID NO: 602 - protein, 12 aa, Saccharomyces cerevisiae
DVTKHEFKRTTY

SEQ ID NO: 603 - protein, 13 aa, Saccharomyces cerevisiae
ISMIGVLDVTKHE

SEQ ID NO: 604 - protein, 12 aa, Saccharomyces cerevisiae
SHHHHHHHHLVL

SEQ ID NO: 605 - protein, 13 aa, Saccharomyces cerevisiae
TKHEFKRTTYSEN

SEQ ID NO: 606 - protein, 14 aa, Saccharomyces cerevisiae
GSHHHHHHHHLVLG

SEQ ID NO: 607 - protein, 14 aa, Saccharomyces cerevisiae
MGSHHHHHHHHLVL

SEQ ID NO: 608 - protein, 14 aa, Saccharomyces cerevisiae
KRTTYSENEVYDLN

SEQ ID NO: 609 - protein, 4 aa, Artificial Sequence
  Description of Artificial Sequence: Synthetic peptide
DEAD

The invention claimed is:

1. A nutritive composition comprising an isolated nutritive protein comprising a first polypeptide sequence, wherein the nutritive protein comprises an aqueous solubility of at least 50 g/l at pH7 and a stimulated gastric digestion half-life of less than 10 minutes, and wherein the first polypeptide sequence comprises:
    a. a ratio of Leu residues to total amino acids residues of at least 6%;
    b. a ratio of essential amino acid residues to total amino acid residues of at least 34%;
    c. a ratio of branch chain amino acid residues to total amino acid residues of at least 18%; and
    d. 0, 1, 2, or 3 cysteine residues.

2. The isolated nutritive protein of claim 1, wherein the nutritive protein has an aqueous solubility of at least 100 g/L at pH 7.

3. The isolated nutritive protein of claim 1, wherein the first polypeptide sequence comprises:
    a. a ratio of branch chain amino acid residues to total amino acid residues of at least 20%;
    b. a ratio of Leu residues to total amino acid residues of at least 11%; and
    c. a ratio of essential amino acid residues to total amino acid residues of at least 44%.

4. The isolated nutritive protein of claim 1, wherein the first polypeptide sequence further comprises at least one of each essential amino acid.

5. The isolated nutritive protein of claim 1, wherein the first polypeptide sequence comprises:
    a. a ratio of branch chain amino acid residues to total amino acid residues of at least 23%;
    b. a ratio of Leu residues to total amino acid residues of at least 13%; and
    c. a ratio of essential amino acid residues to total amino acid residues of at least 44%.

6. The isolated nutritive protein of claim 1, wherein the first polypeptide sequence has less than 50% global homology to a known allergen.

7. The isolated nutritive protein of claim 1, wherein the first polypeptide sequence has less than 50% global homology to a known toxin.

8. The isolated nutritive protein of claim 1, wherein the nutritive protein has a simulated gastric digestion half-life of less than 2 minutes.

9. The isolated nutritive protein of claim 1, wherein the first polypeptide sequence has 0 cysteine residues.

10. The isolated nutritive protein of claim 1, wherein the polypeptide sequence, when present at a concentration of 12.5 mg/mL, does not form insoluble aggregates in aqueous solution at 95° C.

11. The isolated nutritive protein of claim 1, wherein the isolated nutritive protein further comprises a polypeptide tag for affinity purification.

12. The nutritive composition of claim 1, further comprising at least one second component selected from a protein, a polypeptide, a peptide, a free amino acid, a carbohydrate, a lipid, a mineral or mineral source, a vitamin, a supplement, an organism, a pharmaceutical, and an excipient.

13. The nutritive composition of claim 1, wherein the nutritive composition is formulated as a liquid solution, slurry, suspension, gel, paste, powder, or solid.

14. The nutritive composition of claim 1, wherein the nutritive protein is at least 90% pure relative to total protein.

15. The isolated nutritive protein of claim 1, wherein the first polypeptide sequence is at least 20, 50, or 100 amino acids in length.

16. The isolated nutritive protein of claim 1, wherein the first polypeptide sequence does not comprise N-linked glycosylation, O-linked glycosylation, or both N-linked and O-linked glycosylation.

17. The nutritive composition of claim 12, further comprising calcium.

* * * * *

UNITED STATES PATENT AND TRADEMARK OFFICE
CERTIFICATE OF CORRECTION

PATENT NO. : 8,809,259 B2  
APPLICATION NO. : 13/836855  
DATED : August 19, 2014  
INVENTOR(S) : David Arthur Berry et al.

Page 1 of 1

It is certified that error appears in the above-identified patent and that said Letters Patent is hereby corrected as shown below:

Title page, item (72) Inventors:

Please add John F. Kramarczyk, Somerville, MA

Signed and Sealed this  
Twenty-eighth Day of April, 2015

Michelle K. Lee  
*Director of the United States Patent and Trademark Office*

UNITED STATES PATENT AND TRADEMARK OFFICE
CERTIFICATE OF CORRECTION

PATENT NO. : 8,809,259 B2  
APPLICATION NO. : 13/836855  
DATED : August 19, 2014  
INVENTOR(S) : David Arthur Berry et al.

Page 1 of 1

It is certified that error appears in the above-identified patent and that said Letters Patent is hereby corrected as shown below:

In the claims

Column 91, line 18-19, Claim 1, after "at least 50" please change "g/1" to "g/L".

Column 91, line 19, Claim 1, after "and a" please change "stimulated" to "simulated".

Signed and Sealed this  
Twenty-first Day of July, 2015

Michelle K. Lee  
*Director of the United States Patent and Trademark Office*